US012668789B2

(12) United States Patent
Vroom et al.

(10) Patent No.: US 12,668,789 B2
(45) **Date of Patent: *Jun. 30, 2026**

(54) ENGINEERED PHOSPHOPENTOMUTASE VARIANT ENZYMES

(71) Applicant: Codexis, Inc., Redwood City, CA (US)

(72) Inventors: Jonathan Vroom, South San Francisco, CA (US); Santhosh Sivaramakrishnan, Redwood City, CA (US); Jessica Anna Hurtak, Mountain View, CA (US)

(73) Assignee: Codexis, Inc., Redwood City, CA (US)

( * ) Notice: Subject to any disclaimer, the term of this patent is extended or adjusted under 35 U.S.C. 154(b) by 470 days.

This patent is subject to a terminal disclaimer.

(21) Appl. No.: 18/247,866

(22) PCT Filed: Oct. 5, 2021

(86) PCT No.: PCT/US2021/053626

§ 371 (c)(1),
(2) Date: Apr. 4, 2023

(87) PCT Pub. No.: WO2022/076454

PCT Pub. Date: Apr. 14, 2022

(65) Prior Publication Data

US 2023/0374486 A1 Nov. 23, 2023

Related U.S. Application Data

(60) Provisional application No. 63/088,556, filed on Oct. 7, 2020.

(51) Int. Cl.
*C12N 9/90* (2006.01)

(52) U.S. Cl.
CPC ........ *C12N 9/90* (2013.01); *C12Y 504/02007* (2013.01)

(58) Field of Classification Search
None
See application file for complete search history.

(56) References Cited

U.S. PATENT DOCUMENTS

| | | | |
|---|---|---|---|
| 5,605,793 | A | 2/1997 | Stemmer |
| 5,811,238 | A | 9/1998 | Stemmer et al. |
| 5,830,721 | A | 11/1998 | Stemmer et al. |
| 5,834,252 | A | 11/1998 | Stemmer et al. |
| 5,837,458 | A | 11/1998 | Minshull et al. |
| 5,928,905 | A | 7/1999 | Stemmer et al. |
| 6,096,548 | A | 8/2000 | Stemmer |
| 6,117,679 | A | 9/2000 | Stemmer |
| 6,132,970 | A | 10/2000 | Stemmer |
| 6,165,793 | A | 12/2000 | Stemmer |
| 6,180,406 | B1 | 1/2001 | Stemmer |
| 6,251,674 | B1 | 6/2001 | Tobin et al. |
| 6,265,201 | B1 | 7/2001 | Wackett et al. |
| 6,277,638 | B1 | 8/2001 | Stemmer |
| 6,287,861 | B1 | 9/2001 | Stemmer et al. |
| 6,287,862 | B1 | 9/2001 | Delcardayre et al. |
| 6,291,242 | B1 | 9/2001 | Stemmer |
| 6,297,053 | B1 | 10/2001 | Stemmer |
| 6,303,344 | B1 | 10/2001 | Patten et al. |
| 6,309,883 | B1 | 10/2001 | Minshull et al. |
| 6,319,713 | B1 | 11/2001 | Patten et al. |
| 6,319,714 | B1 | 11/2001 | Crameri et al. |
| 6,323,030 | B1 | 11/2001 | Stemmer |
| 6,326,204 | B1 | 12/2001 | Delcardayre et al. |
| 6,335,160 | B1 | 1/2002 | Patten et al. |
| 6,335,198 | B1 | 1/2002 | Delcardayre et al. |
| 6,337,186 | B1 | 1/2002 | Krebber |
| 6,344,356 | B1 | 2/2002 | Stemmer |
| 6,352,859 | B1 | 3/2002 | Delcardayre et al. |
| 6,355,484 | B1 | 3/2002 | Patten et al. |
| 6,358,740 | B1 | 3/2002 | Patten et al. |
| 6,358,742 | B1 | 3/2002 | Stemmer |
| 6,365,377 | B1 | 4/2002 | Patten et al. |
| 6,365,408 | B1 | 4/2002 | Stemmer |
| 6,368,861 | B1 | 4/2002 | Crameri et al. |
| 6,372,497 | B1 | 4/2002 | Stemmer |
| 6,376,246 | B1 | 4/2002 | Crameri et al. |
| 6,379,964 | B1 | 4/2002 | Del Cardayre et al. |
| 6,387,702 | B1 | 5/2002 | Stemmer |

(Continued)

FOREIGN PATENT DOCUMENTS

| | | | |
|---|---|---|---|
| WO | 95/22625 | A1 | 8/1995 |
| WO | 95/33836 | A1 | 12/1995 |

(Continued)

OTHER PUBLICATIONS

Hayashi et al., DNA Res. 8(1): 11-22 (2001).*
Altschul et al., "Basic local alignment search tool," J. Mol. Biol., 215: 403-410 [1990].
Altschul et al.,"Gapped BLAST and PSI-BLAST: a new generation of protein database search programs," Nucleic Acids Res.,25,17, 3389-3402 [1977].
Baldino et al., "High-resolution in situ hybridization histochemistry," Meth. Enzymol., 168:761-777 [1989].
Barbas and Wong et al., "Overexpression and substrate specificity studies of phosphodeoxyribomutase and thymidine phosphorylase," Bioorg. Chem. 19:261-269, 1991.
Barbas et al., "Deoxyribose-5-phosphate aldolase as a synthetic catalyst," J. Am. Chem. Soc. 112:2013-2014, 1990.

(Continued)

*Primary Examiner* — Erin M. Bowers
(74) *Attorney, Agent, or Firm* — FisherBroyles, LLP; Adam K. Whiting; Adelaide K. Leitzel

(57) ABSTRACT

The present invention provides engineered phosphopentomutase (PPM) enzymes, polypeptides having PPM activity, and polynucleotides encoding these enzymes, as well as vectors and host cells comprising these polynucleotides and polypeptides. Methods for producing PPM enzymes are also provided. The present invention further provides compositions comprising the PPM enzymes and methods of using the engineered PPM enzymes. The present invention finds particular use in the production of pharmaceutical compounds.

11 Claims, No Drawings

Specification includes a Sequence Listing.

(56) References Cited

U.S. PATENT DOCUMENTS

| | | | |
|---|---|---|---|
| 6,391,552 | B2 | 5/2002 | Stemmer |
| 6,391,640 | B1 | 5/2002 | Minshull et al. |
| 6,395,547 | B1 | 5/2002 | Stemmer |
| 6,406,855 | B1 | 6/2002 | Patten et al. |
| 6,406,910 | B1 | 6/2002 | Patten et al. |
| 6,413,745 | B1 | 7/2002 | Patten et al. |
| 6,413,774 | B1 | 7/2002 | Stemmer et al. |
| 6,420,175 | B1 | 7/2002 | Stemmer |
| 6,423,542 | B1 | 7/2002 | Crameri et al. |
| 6,426,224 | B1 | 7/2002 | Crameri et al. |
| 6,436,675 | B1 | 8/2002 | Welch et al. |
| 6,444,468 | B1 | 9/2002 | Stemmer et al. |
| 6,455,253 | B1 | 9/2002 | Patten et al. |
| 6,479,652 | B1 | 11/2002 | Crameri et al. |
| 6,482,647 | B1 | 11/2002 | Stemmer |
| 6,483,011 | B1 | 11/2002 | Stemmer et al. |
| 6,484,105 | B2 | 11/2002 | Zhang |
| 6,489,146 | B2 | 12/2002 | Stemmer et al. |
| 6,500,617 | B1 | 12/2002 | Stemmer et al. |
| 6,500,639 | B2 | 12/2002 | Subramanian |
| 6,506,602 | B1 | 1/2003 | Stemmer |
| 6,506,603 | B1 | 1/2003 | Stemmer |
| 6,518,065 | B1 | 2/2003 | Stemmer |
| 6,519,065 | B1 | 2/2003 | Colbourne et al. |
| 6,521,453 | B1 | 2/2003 | Crameri et al. |
| 6,528,311 | B1 | 3/2003 | Delcardayre et al. |
| 6,537,746 | B2 | 3/2003 | Arnold et al. |
| 6,573,098 | B1 | 6/2003 | Stemmer |
| 6,576,467 | B1 | 6/2003 | Stemmer |
| 6,579,678 | B1 | 6/2003 | Patten et al. |
| 6,586,182 | B1 | 7/2003 | Patten et al. |
| 6,602,986 | B1 | 8/2003 | Stemmer et al. |
| 6,605,430 | B1 | 8/2003 | Affholter et al. |
| 6,613,514 | B2 | 9/2003 | Patten et al. |
| 6,653,072 | B1 | 11/2003 | Patten et al. |
| 6,686,515 | B1 | 2/2004 | Lassner et al. |
| 6,703,240 | B1 | 3/2004 | Stemmer et al. |
| 6,716,631 | B1 | 4/2004 | Delcardayre et al. |
| 6,825,001 | B2 | 11/2004 | Wackett et al. |
| 6,902,922 | B2 | 6/2005 | Ness et al. |
| 6,917,882 | B2 | 7/2005 | Selifonov et al. |
| 6,946,296 | B2 | 9/2005 | Patten et al. |
| 6,961,664 | B2 | 11/2005 | Selifonov et al. |
| 6,995,017 | B1 | 2/2006 | Stemmer |
| 7,024,312 | B1 | 4/2006 | Selifonov et al. |
| 7,058,515 | B1 | 6/2006 | Selifonov et al. |
| 7,105,297 | B2 | 9/2006 | Minshull et al. |
| 7,148,054 | B2 | 12/2006 | Delcardayre et al. |
| 7,220,566 | B2 | 5/2007 | Ness et al. |
| 7,229,797 | B1 | 6/2007 | Tischer et al. |
| 7,288,375 | B2 | 10/2007 | Stemmer et al. |
| 7,384,387 | B1 | 6/2008 | Raillard et al. |
| 7,421,347 | B2 | 9/2008 | Selifonov et al. |
| 7,430,477 | B2 | 9/2008 | Selifonov et al. |
| 7,462,469 | B2 | 12/2008 | Bass et al. |
| 7,534,564 | B2 | 5/2009 | Patten et al. |
| 7,620,500 | B2 | 11/2009 | Mundorff et al. |
| 7,620,502 | B2 | 11/2009 | Selifonov et al. |
| 7,629,170 | B2 | 12/2009 | Delcardayre et al. |
| 7,702,464 | B1 | 4/2010 | Emig et al. |
| 7,747,391 | B2 | 6/2010 | Gustafsson et al. |
| 7,747,393 | B2 | 6/2010 | Fox |
| 7,751,986 | B2 | 7/2010 | Gustafsson et al. |
| 7,776,598 | B2 | 8/2010 | Patten et al. |
| 7,783,428 | B2 | 8/2010 | Gustafsson et al. |
| 7,795,030 | B2 | 9/2010 | Minshull et al. |
| 7,853,410 | B2 | 12/2010 | Selifonov et al. |
| 7,868,138 | B2 | 1/2011 | Stemmer et al. |
| 7,873,477 | B1 | 1/2011 | Gustafsson et al. |
| 7,873,499 | B2 | 1/2011 | Selifonov et al. |
| 7,904,249 | B2 | 3/2011 | Selifonov et al. |
| 7,957,912 | B2 | 6/2011 | Selifonov et al. |
| 7,981,614 | B2 | 7/2011 | Stemmer et al. |
| 8,014,961 | B2 | 9/2011 | Bass et al. |
| 8,029,988 | B2 | 10/2011 | Crameri et al. |
| 8,048,674 | B2 | 11/2011 | Minshull et al. |
| 8,058,001 | B2 | 11/2011 | Crameri et al. |
| 8,076,138 | B2 | 12/2011 | Delcardayre et al. |
| 8,108,150 | B2 | 1/2012 | Mundorff et al. |
| 8,170,806 | B2 | 5/2012 | Selifonov et al. |
| 8,224,580 | B2 | 7/2012 | Mundorff et al. |
| 8,377,681 | B2 | 2/2013 | Delcardayre et al. |
| 8,383,346 | B2 | 2/2013 | Colbeck et al. |
| 8,457,903 | B1 | 6/2013 | Emig et al. |
| 8,504,498 | B2 | 8/2013 | Fox |
| 8,589,085 | B2 | 11/2013 | Selifonov et al. |
| 8,758,764 | B2 * | 6/2014 | Masignani ......... A61K 39/0258 424/257.1 |
| 8,762,066 | B2 | 6/2014 | Fox |
| 8,768,871 | B2 | 7/2014 | Fox |
| 9,593,326 | B2 | 3/2017 | Clark et al. |
| 9,714,437 | B2 | 7/2017 | Chan et al. |
| 2008/0220990 | A1 | 9/2008 | Fox |
| 2009/0312196 | A1 | 12/2009 | Colbeck et al. |
| 2020/0010823 | A1 | 1/2020 | Novick et al. |

FOREIGN PATENT DOCUMENTS

| | | | |
|---|---|---|---|
| WO | 96/00787 | A1 | 1/1996 |
| WO | 97/00078 | A1 | 1/1997 |
| WO | 97/35966 | A1 | 10/1997 |
| WO | 98/27230 | A1 | 6/1998 |
| WO | 00/42561 | A2 | 7/2000 |
| WO | 01/75767 | A2 | 10/2001 |
| WO | 2009/152336 | A1 | 12/2009 |

OTHER PUBLICATIONS

Bolton et al., "A General Method for the Isolation of RNA Complementary to DNA," Proc. Natl. Acad. Sci. USA 48,8:1390-1397 [1962].

Botstein et al., "Strategies and applications of in vitro mutagenesis," Science, 229, 4719:1193-1201 [1985].

Breslauer et al., "Human cDNA clones for four species of G alpha s signal transduction protein.," Proc. Natl. Acad. Sci. USA 83:8893-8897 [1986].

Carter, "Site-directed mutagenesis," Biochem. J., 237,1:1-7 [1986].

Chaveroche et al., "A rapid method for efficient gene replacement in the filamentous fungus *Aspergillus nidulans*," Nucleic Acids Research, 28(22), 97e-97,2000.

Cho et al., "A High Throughput Targeted Gene Disruption Method for Alternaria brassicicola Functional Genomics Using Linear Minimal Element (LME) Constructs," Molec. Plant Microbe Interact., 19:7-15 [2006].

Christians et al., "Directed evolution of thymidine kinase for AZT phosphorylation using DNA family shuffling," Nat. Biotechnol., 17,3:259-264 [1999].

Combier et al., "*Agrobacterium tumefaciens*-mediated transformation as a tool for insertional mutagenesis in the symbiotic ectomycorrhizal fungus *Hebeloma cylindrosporum*," FEMS Microbiol. Lett., 220:141-8, 2003.

Crameri et al., "DNA shuffling of a family of genes from diverse species accelerates directed evolution," Nature, 391:288-291 [1998].

Crameri et al., "Improved Green Fluorescent Protein by Molecular Evolution Using DNA Shuffling," Nat. Biotechnol., 14:315-319 [1996].

Crameri et al., "Molecular evolution of an arsenate detoxification pathway by DNA shuffling," Nat. Biotechnol., 15:436-438 [1997].

Dale et al., "Oligonucleotide-Directed Random Mutagenesis Using the Phosphorothioate Method," Meth. Mol. Biol., 57:369-374 [1996].

DeBoer et al., "The tac promoter: a functional hybrid derived from the trp and lac promoters," Proc. Natl Acad. Sci. USA,80: 21-25, 1983.

Ehrlich et al., "DNA cloning in Bacillus subtilis," Proc. Natl. Acad. Sci. USA 75:1433, 1978.

Eisenberg et al.,"Analysis of membrane and surface protein sequences with the hydrophobic moment plot," J. Mol. Biol., 179,1:125-142 [1984].

(56) References Cited

OTHER PUBLICATIONS

Firon et al., "Identification of Essential Genes in the Human Fungal Pathogen *Aspergillus fumigatus* by Transposon Mutagenesis," Eukary. Cell 2:247-55 [2003].
Freier et al., "Improved free-energy parameters for predictions of RNA duplex stability," Proc. Natl. Acad. Sci. USA 83,24:9373-9377 [1986].
Guo et al., "3'-End-Forming Signals of Yeast mRNA," Mol. Cell. Biol., 15, 11:5983-5990 [1995].
Hamamoto et al., "Phosphopentomutase of Bacillus stearothermophilus TH6-2: The Enzyme and Its Gene ppm," Biosci. Biotechnol., Biochem. 62:1103-1108, 1998.
Henaut et al., "Analysis and Predictions from *Escherichia coli* Sequences, or *E. coli* In Silico," in *Escherichia coli* and *Salmonella*, Neidhardt, et al. (eds.), ASM Press, Washington D.C.,p. 2047-2066 [1996].
Henikoff et al., "Amino acid substitution matrices from protein blocks," Proc. Natl. Acad. Sci. USA 89, 22:10915 [1989].
Hong et al.,"Cloning and functional expression of thermostable beta-glucosidase gene from *Thermoascus aurantiacus*," Appl. Microbiol. Biotechnol., 73:1331, 2007.
Horinouchi, N., et al., "Screening and characterization of a phosphopentomutase useful for enzymatic production pf2'-deoxyribonucleoside," New Biotechnol., 26 (1/2):75-82 [2009].
Iverson et al., "Molecular differences between a mutase and a phosphatase: investigations of the activation step in Bacillus cereus phosphopentomutase," Biochemistry, 6, Mar. 2012, vol. 51, No. 9, pp. 1964-1975. INIH Public Access copy provided] Especially abstract.
Wetmur, "DNA Probes: Applications of the Principles of Nucleic Acid Hybridization," Rev. Biochem. Mol. Biol. 26:227-259 [1991].
Jordheim et al., "Advances in the development of nucleoside and nucleotide analogues for cancer and viral diseases," Nat. Rev. Drug Discovery 12:447-464, 2013.
Kierzek et al., "Polymer-supported RNA synthesis and its application to test the nearest-neighbor model for duplex stability," Biochem., 25,24:7840-7846 [1986].
Kramer et al., "Different base/base mismatches are corrected with different efficiencies by the methyl-directed DNA mismatch-repair system of *E. coli*," Cell, 38,3:879-887 [1984].
Lathe et al., "Plasmid and bacteriophage vectors for excision of intact inserts," Gene 57:193-201 [1987].
Ling et al., "Approaches to DNA Mutagenesis: An Overview," Anal. Biochem., 254(2):157-178 [1997].
Maruyama and Kitamoto et al., "Multiple gene disruptions by marker recycling with highly efficient gene-targeting background (DeltaligD) in *Aspergillus oryzae*," Biotechnol Lett., 30:1811-1817, 2008.
Mclnerney, "GCUA: General Codon Usage Analysis," Bioinformatics, 14(4), 372-373 [1998].
Minshull et al., "Protein evolution by molecular breeding," Curr. Op. Chem. Biol., 3,3:284-290 [1999].
Mount, Bioinformatics: Sequence and Genome Analysis, Chapter 8, Cold Spring Harbor Laboratory Press, Cold Spring Harbor, N.Y. [ 2001].
Nakamura et al., "Codon usage tabulated from international DNA sequence databases: status for the year 2000," Nucl. Acids Res., 28,1:292[2000].
Needleman et al., "A general method applicable to the search for similarities in the amino acid sequence of two proteins," J. Mol. Biol., 48:443-453 [1970].
Panosian et al., "Bacillus cereus Phosphopentomutase is an Alkaline Phosphatase Family Member That Exhibits an Altered Entry Point into the Catalytic Cycle*," J. Biol. Chem. 286:8043-8054, 2011.
Panosian et al., "Crystallization and preliminary X-ray analysis of a phosphopentomutase from Bacillus cereus," Acta Crystallogr., Sect. F: Struct. Biol. Cryst. Commun., 66:811-814, 2010.
Parry et al., "Biochemical characterization and mechanism of action of a thermostable beta-glucosidase purified from *Thermoascus aurantiacus*," Biochem. J., 353:117, 2001.
Pearson et al., "Improved tools for biological sequence comparison," Proc. Natl. Acad. Sci. USA 85:2444-2448 [1988].
Porath et al., Immobilized metal ion affinity chromatography, Prot. Exp. Purification, 3,4:263-281 [1992].
Romanos et al., "Foreign Gene Expression in Yeast: a Review," Yeast 8:423-488 [1992].
Rychlik et al., "Optimization of the annealing temperature for DNA amplification in vitro," [published erratum appears in Nucleic Acids Res 1991;19:698]. Nucleic Acids Res 1990;18:6409-12.
Simonen et al., "Protein secretion in *Bacillus* species," Microbiol. Rev., 57:109-137, 1993.
Smith et al., "Comparison of biosequences," Adv. Appl. Math., 2:482-489 [1981].
Smith M., "In Vitro Mutagenesis," Annual Review of Genetics, 19(1), 423-462 [1985].
Stemmer, "DNA shuffling by random fragmentation and reassembly: In vitro recombination for molecular evolution," Proc. Natl. Acad. Sci. USA 91:10747-10751 [1994].
Stemmer, "Rapid evolution of a protein in vitro by DNA shuffling," Nature, 370:389-391 [1994].
Stenico et al., "Codon usage in Caenorhabditis elegans: delineation of translational selection and mutational biases," Nucleic Acids Research, 22(13), 2437-2446 [1994].
Suggs et al., "In: Brown DD (ed) ICN-UCLA 23rd Symposium on Developmental Biology using Purified Genes," pp. 683-693. Academic Press, New York [1981].
Takahashi et al., "Efficient gene disruption in the koji-mold *Aspergillus sojae* using a novel variation of the positive-negative method," Mol. Gen. Genom., 272: 344-352, 2004.
Tiwari et al., "Prediction of probable genes by Fourier analysis of genomic sequences," Comput. Appl. Biosci., 13:263-270 [1997].
Uberbacher et al., "Discovering and understanding genes in human DNA sequence using GRAIL," Meth. Enzymol., 266:259-281 [1996].
Villa-Komaroff L et al., "A bacterial clone synthesizing proinsulin," Proceedings of the National Academy of Sciences, 75(8), 3727-3731, 1978.
Wada et al., "Codon usage tabulated from the GenBank genetic sequence data," Nucl. Acids Res., 20:2111-2118 [1992].
Walther et al., "The PGM3 gene encodes the major phosphoribomutase in the yeast *Saccharomyces cerevisiae*," FEBS Lett. 586:4114-4118, 2012.
Wells et al., "Cassette mutagenesis: an efficient method for generation of multiple mutations at defined sites," Gene, 34,2-3:315-323 [1985].
Wilson et al., "The structure of an antigenic determinant in a protein," Cell 37,3:767-778 [1984].
Wright, "The 'effective number of codons' used in a gene," Gene, 87,1:23-29 [1990].
You et al., "Gene-specific disruption in the filamentous fungus *Cercospora nicotianae* using a split-marker approach," Arch. Microbiol., 191:615-622, 2009.
Zhang et al.,"Directed evolution of a fucosidase from a galactosidase by DNA shuffling and screening," Proc. Nat. Acad. Sci. U.S.A., 94,9:4504-4509 [1997].
Batzer, M.A., "Erratum: Structure and variability of recently inserted Alu family members", Nucleic Acids Res 19:698-699 [1991].
Tozzi et al., "Pentose phosphates in nucleoside interconversion and catabolism", The FEBS Journal, 273 (6):1089-1101 [2006].

* cited by examiner

ENGINEERED PHOSPHOPENTOMUTASE VARIANT ENZYMES

The present application is a national stage application filed under 35 USC § 371 and claims priority to PCT International Application No. PCT/US21/53626, filed Oct. 5, 2021, which claims priority to U.S. Prov. Pat. Appln. Ser. No. 63/088,556, filed Oct. 7, 2020, both of which are hereby incorporated by reference in their entirety, for all purposes.

FIELD OF THE INVENTION

The present invention provides engineered phosphopentomutase (PPM) enzymes, polypeptides having PPM activity, and polynucleotides encoding these enzymes, as well as vectors and host cells comprising these polynucleotides and polypeptides. Methods for producing PPM enzymes are also provided. The present invention further provides compositions comprising the PPM enzymes and methods of using the engineered PPM enzymes. The present invention finds particular use in the production of pharmaceutical compounds.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-209WO1_ST25.txt", a creation date of Oct. 5, 2021 and a size of 1.33 MB. The Sequence Listing filed via EFS-Web is part of the specification and incorporated in its entirety by reference herein.

BACKGROUND OF THE INVENTION

The retrovirus designated as human immunodeficiency virus (HIV) is the etiological agent of acquired immune deficiency syndrome (AIDS), a complex disease that involves progressive destruction of affected individuals' immune systems and degeneration of the central and peripheral nervous systems. A common feature of retrovirus replication is reverse transcription of the viral RNA genome by a virally-encoded reverse transcriptase to generate DNA copies of HIV sequences, required for viral replication. Some compounds, such as MK-8591, are known reverse transcriptase inhibitors and have found use in the treatment of AIDS and similar diseases. While there are some compounds known to inhibit HIV reverse transcriptase, there remains a need in the art for additional compounds that are more effective in inhibiting this enzyme and thereby ameliorating the effects of AIDS.

Nucleoside analogues such as MK-8591 (Merck) are effective inhibitors of HIV's reverse transcriptase due to their similarity to natural nucleosides used in the synthesis of DNA. The binding of these analogues by the reverse transcriptase stalls the synthesis of DNA by inhibiting the progressive nature of the reverse transcriptase. The stalling of the enzyme results in the premature termination of the DNA molecule, making it ineffective. However, production of nucleoside analogues by standard chemical synthetic techniques can pose a challenge due to their chemical complexity.

SUMMARY OF THE INVENTION

The present invention provides engineered phosphopentomutase (PPM) enzymes, polypeptides having PPM activity, and polynucleotides encoding these enzymes, as well as vectors and host cells comprising these polynucleotides and polypeptides. Methods for producing PPM enzymes are also provided. The present invention further provides compositions comprising the PPM enzymes and methods of using the engineered PPM enzymes. The present invention finds particular use in the production of pharmaceutical compounds.

The present invention provides engineered phosphopentomutases comprising polypeptide sequences having at least 85%, 86%, 87%, 88%, 89%, 90%, 91%, 92%, 93%, 94%, 95%, 96%, 97%, 98%, 99%, or more sequence identity to SEQ ID NO: 4, 12, 16, 90, 198, 352, 412 and/or 418, or a functional fragment thereof, wherein said engineered phosphopentomutase comprises a polypeptide comprising at least one substitution or substitution set in said polypeptide sequence, and wherein the amino acid positions of said polypeptide sequence are numbered with reference to SEQ ID NO: 4, 12, 16, 90, 198, 352, 412 and/or 418. In some embodiments, the polypeptide sequence has at least 85%, 86%, 87%, 88%, 89%, 90%, 91%, 92%, 93%, 94%, 95%, 96%, 97%, 98%, 99%, or more sequence identity to SEQ ID NO: 4, and wherein the polypeptide of the engineered phosphopentomutase comprises at least one substitution or substitution set at one or more positions in said polypeptide sequence selected from 22/68/180/188/257/266, 22/68/257/266, 22/137/257/266, 22/180/188/257/334, 22/188/257/266/341, 22/257/266, 22/257/355, 82/92/192/308, 82/308, 151/225/251/256/257/287/355/357/391, 188/257/266/334, 188/257/266/334/355, 257/341, 257/355, and 308, wherein the amino acid positions of said polypeptide sequence are numbered with reference to SEQ ID NO: 4. In some embodiments, the polypeptide sequence of the engineered phosphopentomutase has at least 85%, 86%, 87%, 88%, 89%, 90%, 91%, 92%, 93%, 94%, 95%, 96%, 97%, 98%, 99%, or more sequence identity to SEQ ID NO: 4, and wherein the polypeptide of the engineered phosphopentomutase comprises at least one substitution or substitution set at one or more positions in said polypeptide sequence selected from 22K/68A/180A/188E/257V/266G, 22K/68A/257V/266G, 22K/137G/257V/266G, 22K/180A/188E/257V/334A, 22K/188E/257V/266G/341L, 22K/257V/266G, 22K/257V/355P, 82P/92L/192T/308L, 82P/308L, 151E/225K/251G/256S/257V/287E/355T/357T/391V, 188E/257V/266G/334A, 188E/257V/266G/334A/355P, 257V/341L, 257V/355P, and 308L, wherein the amino acid positions of said polypeptide sequence are numbered with reference to SEQ ID NO: 4. In some embodiments, the polypeptide sequence of the engineered phosphopentomutase has at least 85%, 86%, 87%, 88%, 89%, 90%, 91%, 92%, 93%, 94%, 95%, 96%, 97%, 98%, 99%, or more sequence identity to SEQ ID NO: 4, and wherein the polypeptide of the engineered phosphopentomutase comprises at least one substitution or substitution set at one or more positions in said polypeptide sequence selected from R22K/S68A/C180A/D188E/A257V/N266G, R22K/S68A/A257V/N266G, R22K/N137G/A257V/N266G, R22K/C180A/D188E/A257V/S334A, R22K/D188E/A257V/N266G/I341L, R22K/A257V/N266G, R22K/A257V/K355P, V82P/M92L/E192T/S308L, V82P/S308L, T151E/Q225K/H251G/G256S/A257V/K287E/K355T/E357T/L391V, D188E/A257V/N266G/S334A, D188E/A257V/N266G/S334A/K355P, A257V/1341L, A257V/K355P, and S308L, wherein the amino acid positions of said polypeptide sequence are numbered with reference to SEQ ID NO: 4. In some embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 4. In some embodiments, the engineered phosphopentomutase comprises a polypeptide sequence having at least 90%, 91%, 92%, 93%, 94%, 95%, 96%, 97%, 98%, 99%, or more sequence identity to SEQ ID NO: 4. In some embodiments, the engineered phosphopentomutase comprises a polypeptide sequence having at least 95%, 96%, 97%, 98%, 99%, or more sequence identity to SEQ ID NO: 4.

In some embodiments, the present invention provides an engineered phosphopentomutase having a polypeptide sequence that is at least 85%, 86%, 87%, 88%, 89%, 90%, 91%, 92%, 93%, 94%, 95%, 96%, 97%, 98%, 99%, or more sequence identity to SEQ ID NO: 12, and wherein the polypeptide of said engineered phosphopentomutase comprises at least one substitution or substitution set at one or more positions in said polypeptide sequence selected from 22, 118, 150, 155, 191, 235, 238, 239, 244, 256, 263, 265, 266, 267, 284, and 355, wherein the amino acid positions of said polypeptide sequence are numbered with reference to SEQ ID NO: 12. In some embodiments, the present invention provides an engineered phosphopentomutase having a polypeptide sequence that is at least 85%, 86%, 87%, 88%, 89%, 90%, 91%, 92%, 93%, 94%, 95%, 96%, 97%, 98%, 99%, or more sequence identity to SEQ ID NO: 12, and wherein the polypeptide of said engineered phosphopentomutase comprises at least one substitution or substitution set at one or more positions in said polypeptide sequence selected from 22A, 118R, 150V, 155L, 191M, 235K, 235Q, 238Q, 238S, 238T, 239A, 239R, 239S, 239V, 244F, 244S, 256A, 263L, 265S, 266E, 266N, 267S, 267T, 267V, 284T, 284V, and 355V, wherein the amino acid positions of said polypeptide sequence are numbered with reference to SEQ ID NO: 12. In some embodiments, the present invention provides an engineered phosphopentomutase having a polypeptide sequence that is at least 85%, 86%, 87%, 88%, 89%, 90%, 91%, 92%, 93%, 94%, 95%, 96%, 97%, 98%, 99%, or more sequence identity to SEQ ID NO: 12, and wherein the polypeptide of said engineered phosphopentomutase comprises at least one substitution or substitution set at one or more positions in said polypeptide sequence selected from K22A, K118R, T150V, Q155L, Y191M, I235K, I235Q, G238Q, G238S, G238T, G239A, G239R, G239S, G239V, Q244F, Q244S, G256A, I263L, A265S, G266E, G266N, R267S, R267T, R267V, A284T, A284V, and K355V, wherein the amino acid positions of said polypeptide sequence are numbered with reference to SEQ ID NO: 12. In some embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 12. In some embodiments, the engineered phosphopentomutase comprises a polypeptide sequence having at least 90%, 91%, 92%, 93%, 94%, 95%, 96%, 97%, 98%, 99%, or more sequence identity to SEQ ID NO: 12. In some embodiments, the engineered phosphopentomutase comprises a polypeptide sequence having at least 95%, 96%, 97%, 98%, 99%, or more sequence identity to SEQ ID NO: 12.

In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 16, and wherein the polypeptide of said engineered phosphopentomutase comprises at least one substitution or substitution set at one or more positions in said polypeptide sequence selected 22/82, 22/82/238, 22/118/256, 22/191/238/256, 22/238, 82/118/191, 82/118/238, 82/238, 82/238/256, 118/191, 118/238, 150, 150/155/180/239, 150/155/188/235/334, 150/155/235/239/334, 150/180/188, 150/188/235/239/334, 150/235/239, 150/235/239/334, 155/188/235/239, 155/235, 155/235/239, 155/235/239/244, 180/188/239/334, 180/334, 188/235/308, 188/239/265/308, 188/239/266, 188/239/308, 188/308, 188/308/334, 235, 235/239, 235/239/244, 238, 238/256, 238/316, 239, 239/308, 265, 308, 308/334, and 334, wherein the amino acid positions of said polypeptide sequence are numbered with reference to SEQ ID NO: 16. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 16, and wherein the polypeptide of said engineered phosphopentomutase comprises at least one substitution or substitution set at one or more positions in said polypeptide sequence selected from 22R/82P, 22R/82P/238T, 22R/118R/256A, 22R/191M/238S/256A, 22R/238T, 82P/118R/191M, 82P/118R/238T, 82P/238Q/256A, 82P/238S, 82P/238T, 118R/191M, 118R/238T, 150V, 150V/155L/180C/239A, 150V/155L/188D/235Q/334S, 150V/155L/235Q/239S/334S, 150V/180C/188D, 150V/188D/235Q/239A/334S, 150V/235Q/239A/334S, 150V/235Q/239S, 155L/188D/235Q/239S, 155L/235Q, 155L/235Q/239S, 155L/235Q/239S/244F, 180C/188D/239S/334S, 180C/334S, 188D/235Q/308L, 188D/239A/265S/308L, 188D/239S/266E, 188D/239S/308L, 188D/308L, 188D/308L/334S, 235Q, 235Q/239A/244F, 235Q/239S, 235Q/239S/244F, 238S, 238S/316T, 238T, 238T/256A, 239S, 239S/308L, 265S, 308L, 308L/334S, and 334S, wherein the amino acid positions of said polypeptide sequence are numbered with reference to SEQ ID NO: 16. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO:16, and wherein the polypeptide of said engineered phosphopentomutase comprises at least one substitution or substitution set at one or more positions in said polypeptide sequence selected from K22R/V82P, K22R/V82P/G238T, K22R/K118R/G256A, K22R/Y191M/G238S/G256A, K22R/G238T, V82P/K118R/Y191M, V82P/K118R/G238T, V82P/G238Q/G256A, V82P/G238S, V82P/G238T, K118R/Y191M, K118R/G238T, T150V, T150V/Q155L/A180C/G239A, T150V/Q155L/E188D/I235Q/A334S, T150V/Q155L/I235Q/G239S/A334S, T150V/A180C/E188D, T150V/E188D/I235Q/G239A/A334S, T150V/I235Q/G239A/A334S, T150V/I235Q/G239S, Q155L/E188D/I235Q/G239S, Q155L/I235Q, Q155L/I235Q/G239S, Q155L/I235Q/G239S/Q244F, A180C/E188D/G239S/A334S, A180C/A334S, E188D/1235Q/S308L, E188D/G239A/A265S/S308L, E188D/G239S/N266E, E188D/G239S/S308L, E188D/S308L, E188D/S308L/A334S, I235Q, I235Q/G239A/Q244F, I235Q/G239S, I235Q/G239S/Q244F, G238S, G238S/A316T, G238T, G238T/G256A, G239S, G239S/S308L, A265S, S308L, S308L/A334S, and A334S, wherein the amino acid positions of said polypeptide sequence are numbered with reference to SEQ ID NO: 16. In some embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 16. In some embodiments, the engineered phosphopentomutase comprises a polypeptide sequence having at least 90%, 91%, 92%, 93%, 94%, 95%, 96%, 97%, 98%, 99%, or more sequence identity to SEQ ID NO: 16. In some embodiments, the engineered phosphopentomutase comprises a polypeptide sequence having at least 95%, 96%, 97%, 98%, 99%, or more sequence identity to SEQ ID NO: 16.

In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 90, and wherein the polypeptide of said engineered phosphopentomutase comprises at least one substitution or substitution set at one or more positions in said polypeptide sequence selected from 16, 21, 22, 52, 53, 65, 77, 82, 114, 118, 120, 133, 135, 155, 156, 172, 188, 189, 191, 220, 221, 222, 225, 236, 244, 251, 257, 261, 267, 284, 287, 334, 357, 369, 391, 394, and 397, wherein the amino acid positions of said polypeptide sequence are numbered with reference to SEQ ID NO: 90. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 90, and wherein the polypeptide of said engineered phosphopentomutase comprises at least one substitution or substitution set at one or more positions in said polypeptide sequence selected from 16S, 21, 21Q, 22M, 52E, 52K, 52S, 52V, 53A, 53G, 53T, 65A, 65G, 77A, 77E, 77Q, 77R, 77T, 82A, 82D, 82K, 114Q, 1181, 118L, 120P, 120R, 120V, 133L, 133T, 135K, 135L, 155D, 155E, 155M, 155R, 155V, 155Y, 156E, 156V, 172A, 188A, 189S, 1911, 220R, 220V, 221E, 221H, 222L, 222S, 225V, 236P, 244A, 244K, 251R, 251S, 251T, 251V, 251Y, 257L, 261G, 267K, 267Q, 284T, 287C, 287G, 287L, 334C, 357M, 369L, 369V, 369W, 391A, 391V, 394L, 397C, 397D, 397E, 397I, 397L, and 397V, wherein the amino acid positions of said polypeptide sequence are numbered with reference to SEQ ID NO: 90. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 90, and wherein the polypeptide of said engineered phosphopentomutase comprises at least one substitution or substitution set at one or more positions in said polypeptide sequence selected from A16S, E211, E21Q, K22M, N52E, N52K, N52S, N52V, V53A, V53G, V53T, H65A, H65G, D77A, D77E, D77Q, D77R, D77T, V82A, V82D, V82K, M114Q, K1181, K118L, L120P, L120R, L120V, V133L, V133T, R135K, R135L, Q155D, Q155E, Q155M, Q155R, Q155V, Q155Y, L156E, L156V, E172A, D188A, K189S, Y1911, K220R, K220V, A221E, A221H, G222L, G222S, Q225V, E236P, Q244A, Q244K, H251R, H251S, H251T, H251V, H251Y, V257L, A261G, R267K, R267Q, A284T, K287C, K287G, K287L, A334C, E357M, Y369L, Y369V, Y369W, L391A, L391V, Y394L, T397C, T397D, T397E, T397I, T397L, and T397V, wherein the amino acid positions of said polypeptide sequence are numbered with reference to SEQ ID NO: 90. In some embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 90. In some embodiments, the engineered phosphopentomutase comprises a polypeptide sequence having at least 90%, 91%, 92%, 93%, 94%, 95%, 96%, 97%, 98%, 99%, or more sequence identity to SEQ ID NO: 90. In some embodiments, the engineered phosphopentomutase comprises a polypeptide sequence having at least 95%, 96%, 97%, 98%, 99%, or more sequence identity to SEQ ID NO: 90.

In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 90, and wherein the polypeptide of said engineered phosphopentomutase comprises at least one substitution or substitution set at one or more positions in said polypeptide sequence selected from 21/79/308, 21/276/301, 77, 117, 147, 150, 156, 179, 220, 221, 222, 239, 261, 266/276/287/308, 266/308, 272, 284, 301, 308, 355, and 391, wherein the amino acid positions of said polypeptide sequence are numbered with reference to SEQ ID NO: 90. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 90, and wherein the polypeptide of said engineered phosphopentomutase comprises at least one substitution or substitution set at one or more positions in said polypeptide sequence selected from 21W/79D/308V, 21W/276S/301N, 77E, 117W, 147G, 150S, 156E, 156W, 179G, 220R, 221E, 222S, 239V, 261I, 261V, 266G/276S/287V/308V, 266G/308V, 272G, 284T, 301N, 308V, 355T, and 391V, wherein the amino acid positions of said polypeptide sequence are numbered with reference to SEQ ID NO: 90. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 90, and wherein the polypeptide of said engineered phosphopentomutase comprises at least one substitution or substitution set at one or more positions in said polypeptide sequence selected from E21W/N79D/L308V, E21W/T276S/C301N, D77E, F117W, A147G, T150S, L156E, L156W, A179G, K220R, A221E, G222S, G239V, A261I, A261V, N266G/T276S/K287V/L308V, N266G/L308V, K272G, A284T, C301N, L308V, K355T, and L391V, wherein the amino acid positions of said polypeptide sequence are numbered with reference to SEQ ID NO: 90. In some embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 90. In some embodiments, the engineered phosphopentomutase comprises a polypeptide sequence having at least 90%, 91%, 92%, 93%, 94%, 95%, 96%, 97%, 98%, 99%, or more sequence identity to SEQ ID NO: 90. In some embodiments, the engineered phosphopentomutase comprises a polypeptide sequence having at least 95%, 96%, 97%, 98%, 99%, or more sequence identity to SEQ ID NO: 90.

In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 198, and wherein the polypeptide of said engineered phosphopentomutase comprises at least one substitution or substitution set at one or more positions in said polypeptide sequence selected from 21, 26, 94, 111, 114, 205, 228, 265, 266, 276, 287, 293, 301, 308, 374, and 401, wherein the amino acid positions of said polypeptide sequence are numbered with reference to SEQ ID NO: 198. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 198, and wherein the polypeptide of said engineered phosphopentomutase comprises at least one substitution or substitution set at one or more positions in said polypeptide sequence selected from 21W, 26E, 26Q, 94L, 111R, 111V, 114M, 205R, 228A, 228S, 265S, 266G, 276S, 287V, 293R, 301N, 308V, 374R, and 401R, wherein the amino acid positions of said polypeptide sequence are numbered with reference to SEQ ID NO: 198. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 198, and wherein the polypeptide of said engineered phosphopentomutase comprises at least one substitution or substitution set at one or more positions in said polypeptide sequence selected from E21W, V26E, V26Q, S94L, L111R, L111V, Q114M, G205R, G228A, G228S, A265S, N266G, T276S, K287V, G293R, C301N, L308V, K374R, and E401R, wherein the amino acid positions of said polypeptide sequence are numbered with reference to SEQ ID NO: 198. In some embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 198. In some embodiments, the engineered phosphopentomutase comprises a polypeptide sequence having at least 90%, 91%, 92%, 93%, 94%, 95%, 96%, 97%, 98%, 99%, or more sequence identity to SEQ ID NO: 198. In some embodiments, the engineered phosphopentomutase comprises a polypeptide sequence having at least 95%, 96%, 97%, 98%, 99%, or more sequence identity to SEQ ID NO: 198.

In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 352, and wherein the polypeptide of said engineered phosphopentomutase comprises at least one substitution or substitution set at one or more positions in said polypeptide sequence selected from 147/156/222/261/284, 147/156/222/261/284/391, 147/156/222/261/391, 147/156/261, 147/156/261/284, 147/156/261/308/334/355/357, 147/156/261/391, 147/156/391, 147/179/261/391, 147/222/284/391, 147/222/391, 147/261, 147/261/391, 147/284/391, 147/391, 156/179/261/284/391, 156/222/261, 156/222/391, 156/239/261/391, 156/239/391, 156/261, 156/261/284, 156/261/284/391, 156/284, 156/391, 222/239/261/391, 222/261, 222/261/284, 222/261/284/293, 222/261/391, 222/391, 239/261/284/391, 261, 261/391, 284/391, and 391, wherein the amino acid positions of said polypeptide sequence are numbered with reference to SEQ ID NO: 352. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 352, and wherein the polypeptide of said engineered phosphopentomutase comprises at least one substitution or substitution set at one or more positions in said polypeptide sequence selected from 147G/156W/222S/261I/284T, 147G/156W/222S/261V/284T, 147G/156W/222S/261V/284T/391V, 147G/156W/222S/261V/391V, 147G/156W/261I/391V, 147G/156W/261V, 147G/156W/261V/284T, 147G/156W/261V/3085/334S/355T/357T, 147G/156W/261V/391V, 147G/156W/391V, 147G/179G/261V/391V, 147G/222S/284T/391V, 147G/222S/391V, 147G/261I, 147G/261V/391V, 147G/284T/391V, 147G/391V, 156E/222S/261I, 156E/239V/391V, 156E/261I, 156E/261I/284T/391V, 156E/391V, 156W/179G/261V/284T/391V, 156W/222S/391V, 156W/239V/261I/391V, 156W/261I/284T, 156W/261V/284T, 156W/284T, 222S/239V/261I/391V, 222S/261I/284T, 222S/261V, 222S/261V/284T/293R, 222S/261V/391V, 222S/391V, 239V/261V/284T/391V, 261V, 261V/391V, 284T/391V, and 391V, wherein the amino acid positions of said polypeptide sequence are numbered with reference to SEQ ID NO: 352. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 352, and wherein the polypeptide of said engineered phosphopentomutase comprises at least one substitution or substitution set at one or more positions in said polypeptide sequence selected from A147G/L156W/G222S/A261I/A284T, A147G/L156W/G222S/A261V/A284T, A147G/L156W/G222S/A261V/A284T/L391V, A147G/L156W/G222S/A261V/L391V, A147G/L156W/A261I/L391V, A147G/L156W/A261V, A147G/L156W/A261V/A284T, A147G/L156W/A261VN3085/A334S/K355T/E357T, A147G/L156W/A261V/L391V, A147G/L156W/L391V, A147G/A179G/A261V/L391V, A147G/G222S/A284T/L391V, A147G/G222S/L391V, A147G/A261I, A147G/A261V/L391V, A147G/A284T/L391V, A147G/L391V, L156E/G222S/A261I, L156E/G239V/L391V, L156E/A261I, L156E/A261I/A284T/L391V, L156E/L391V, L156W/A179G/A261V/A284T/L391V, L156W/G222S/L391V, L156W/G239V/A261I/L391V, L156W/A261I/A284T, L156W/A261V/A284T, L156W/A284T, G222S/G239V/A261I/L391V, G222S/A261I/A284T, G222S/A261V, G222S/A261V/A284T/G293R, G222S/A261V/L391V, G222S/L391V, G239V/A261V/A284T/L391V, A261V, A261V/L391V, A284T/L391V, and L391V, wherein the amino acid positions of said polypeptide sequence are numbered with reference to SEQ ID NO: 352. In some embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 352. In some embodiments, the engineered phosphopentomutase comprises a polypeptide sequence having at least 90%, 91%, 92%, 93%, 94%, 95%, 96%, 97%, 98%, 99%, or more sequence identity to SEQ ID NO: 352. In some embodiments, the engineered phosphopentomutase comprises a polypeptide sequence having at least 95%, 96%, 97%, 98%, 99%, or more sequence identity to SEQ ID NO: 352.

In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 418, and wherein the polypeptide of said engineered phosphopentomutase comprises at least one substitution or substitution set at one or more positions in said polypeptide sequence selected 53, 77, 100, 112, 120, 121, 147/156, 155, 156, 160, 241, 255, 267, 285, 287, and 300, wherein the amino acid positions of said polypeptide sequence are numbered with reference to SEQ ID NO: 418. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 418, and wherein the polypeptide of said engineered phosphopentomutase comprises at least one substitution or substitution set at one or more positions in said polypeptide sequence selected from 53L, 77E, 100A, 112M, 112N, 112R, 120R, 120V, 121K, 121T, 147G/156L, 155R, 156W, 160S, 241S, 255T, 267Q, 285M, 287R, and 300S, wherein the amino acid positions of said polypeptide sequence are numbered with reference to SEQ ID NO: 418. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 418, and wherein the polypeptide of said engineered phosphopentomutase comprises at least one substitution or substitution set at one or more positions in said polypeptide sequence selected from V53L, D77E, S100A, F112M, F112N, F112R, L120R, L120V, E121K, E121T, A147G/E156L, Q155R, E156W, H160S, T241S, V255T, R267Q, T285M, K287R, and T300S, wherein the amino acid positions of said polypeptide sequence are numbered with reference to SEQ ID NO: 418. In some embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 418. In some embodiments, the engineered phosphopentomutase comprises a polypeptide sequence having at least 90%, 91%, 92%, 93%, 94%, 95%, 96%, 97%, 98%, 99%, or more sequence identity to SEQ ID NO: 418. In some embodiments, the engineered phosphopentomutase comprises a polypeptide sequence having at least 95%, 96%, 97%, 98%, 99%, or more sequence identity to SEQ ID NO: 418.

In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 412, and wherein the polypeptide of said engineered phosphopentomutase comprises at least one substitution or substitution set at one or more positions in said polypeptide sequence selected 77/112/121/255, 100, 100/112/155, 112/120/121, 112/120/121/241/255/300, 112/121, 112/121/255/287, 121/255, and 255, wherein the amino acid positions of said polypeptide sequence are numbered with reference to SEQ ID NO: 412. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 412, and wherein the polypeptide of said engineered phosphopentomutase comprises at least one substitution or substitution set at one or more positions in said polypeptide sequence selected 77E/112M/121T/255T, 100A, 100A/112M/155R, 112M/120R/121T, 112M/120R/121T/241S/255T/300S, 112M/121T, 112R/121T/255T/287R, 121T/255T, and 255T, wherein the amino acid positions of said polypeptide sequence are numbered with reference to SEQ ID NO: 412. In some additional embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 412, and wherein the polypeptide of said engineered phosphopentomutase comprises at least one substitution or substitution set at one or more positions in said polypeptide sequence selected from D77E/F112M/E121T/V255T, S100A, S100A/F112M/Q155R, F112M/L120R/E121T, F112M/L120R/E121T/T241SN255T/T300S, F112M/E121T, F112R/E121TN255T/K287R, E121T/V255T, and V255T, wherein the amino acid positions of said polypeptide sequence are numbered with reference to SEQ ID NO: 412. In some embodiments, the engineered phosphopentomutase comprises a polypeptide sequence having at least 85%, 86%, 87%, 88%, 89%, 90%, 91%, 92%, 93%, 94%, 95%, 96%, 97%, 98%, 99%, or more sequence identity to SEQ ID NO: 412. In some embodiments, the engineered phosphopentomutase comprises a polypeptide sequence having at least 90%, 91%, 92%, 93%, 94%, 95%, 96%, 97%, 98%, 99%, or more sequence identity to SEQ ID NO: 412. In some embodiments, the engineered phosphopentomutase comprises a polypeptide sequence having at least 95%, 96%, 97%, 98%, 99%, or more sequence identity to SEQ ID NO: 412.

In some additional embodiments, the present invention provides engineered phosphopentomutases, wherein the engineered phosphopentomutases comprises polypeptide sequences that are at least 85%, 86%, 87%, 88%, 89%, 90%, 91%, 92%, 93%, 94%, 95%, 96%, 97%, 98%, 99% or more identical to the sequence of at least one engineered phosphopentomutase variant set forth in Table 4.1, 5.1, 6.1, 7.1, 8.1, 9.1, 10.1, 11.1, and/or 12.1.

In some additional embodiments, the present invention provides engineered phosphopentomutases, wherein the engineered phosphopentomutases comprises polypeptide sequences that are at least 85%, 86%, 87%, 88%, 89%, 90%, 91%, 92%, 93%, 94%, 95%, 96%, 97%, 98%, 99% or more identical to SEQ ID NO: 4, 12, 16, 90, 198, 352, 412 and/or 418. In some embodiments, the engineered phosphopentomutase comprises a variant engineered phosphopentomutase set forth in SEQ ID NO: 4, 12, 16, 90, 198, 352, 412 and/or 418.

The present invention also provides engineered phosphopentomutases, wherein the engineered phosphopentomutases comprise polypeptide sequences that are at least 85%, 86%, 87%, 88%, 89%, 90%, 91%, 92%, 93%, 94%, 95%, 96%, 97%, 98%, 99% or more identical to the sequence of at least one engineered phosphopentomutase variants set forth in the even numbered sequences of SEQ ID NOS: 6-546.

The present invention further provides engineered phosphopentomutases, wherein said engineered phosphopentomutases comprise at least one improved property compared to wild-type *E. coli* phosphopentomutase. In some embodiments, the improved property comprises improved activity on a substrate. In some further embodiments, the substrate comprises compound (4) and/or compound (3). In some additional embodiments, the improved property comprises improved production of compound (1) and/or compound (3). In some further embodiments, the substrate comprises compound (4). In some additional embodiments, the improved property comprises improved production of compound (1) and/or compound (3). In yet some additional embodiments, the engineered phosphopentomutase is purified. The present invention also provides compositions comprising at least one engineered phosphopentomutase provided herein. The present invention also provides compositions comprising at one engineered phosphopentomutase provided herein.

The present invention also provides polynucleotide sequences encoding at least one engineered phosphopentomutase provided herein. In some embodiments, the polynucleotide sequence encoding at least one engineered phosphopentomutase, comprises a polynucleotide sequence having at least 85%, 86%, 87%, 88%, 89%, 90%, 91%, 92%, 93%, 94%, 95%, 96%, 97%, 98%, 99%, or more sequence identity to SEQ ID NOS: 3, 11, 15, 89, 197, 351, 411 and/or 417. In some embodiments, the polynucleotide sequence encoding at least one engineered phosphopentomutase, comprises a polynucleotide sequence having at least 85%, 86%, 87%, 88%, 89%, 90%, 91%, 92%, 93%, 94%, 95%, 96%, 97%, 98%, 99%, or more sequence identity to SEQ ID NOS: 3, 11, 15, 89, 197, 351, 411 and/or 417, wherein the polynucleotide sequence of said engineered phosphopentomutase comprises at least one substitution at one or more positions. In some further embodiments, the polynucleotide sequence encoding at least one engineered phosphopentomutase comprises at least 85%, 86%, 87%, 88%, 89%, 90%, 91%, 92%, 93%, 94%, 95%, 96%, 97%, 98%, 99%, or more sequence identity to SEQ ID NOS: 3, 11, 15, 89, 197, 351, 411 and/or 417, or a functional fragment thereof. In yet some additional embodiments, the polynucleotide sequence is operably linked to a control sequence. In some further embodiments, the polynucleotide sequence is codon optimized. In still some additional embodiments, the polynucleotide sequence comprises a polynucleotide sequence forth in the odd numbered sequences of SEQ ID NOS: 5-545.

The present invention also provides expression vectors comprising at least one polynucleotide sequence provided herein. The present invention further provides host cells comprising at least one expression vector provided herein. In some embodiments, the present invention provides host cells comprising at least one polynucleotide sequence provided herein.

The present invention also provides methods of producing an engineered phosphopentomutase in a host cell, comprising culturing the host cell provided herein, under suitable conditions, such that at least one engineered phosphopentomutase is produced. In some embodiments, the methods further comprise recovering at least one engineered phosphopentomutase from the culture and/or host cell. In some additional embodiments, the methods further comprise the step of purifying said at least one engineered phosphopentomutase.

DESCRIPTION OF THE INVENTION

The present invention provides engineered phosphopentomutase (PPM) enzymes, polypeptides having PPM activity, and polynucleotides encoding these enzymes, as well as vectors and host cells comprising these polynucleotides and polypeptides. Methods for producing PPM enzymes are also provided. The present invention further provides compositions comprising the PPM enzymes and methods of using the engineered PPM enzymes. The present invention finds particular use in the production of pharmaceutical compounds.

Unless defined otherwise, all technical and scientific terms used herein generally have the same meaning as commonly understood by one of ordinary skill in the art to which this invention pertains. Generally, the nomenclature used herein and the laboratory procedures of cell culture, molecular genetics, microbiology, organic chemistry, analytical chemistry and nucleic acid chemistry described below are those well-known and commonly employed in the art. Such techniques are well-known and described in numerous texts and reference works well known to those of skill in the art. Standard techniques, or modifications thereof, are used for chemical syntheses and chemical analyses. All patents, patent applications, articles and publications mentioned herein, both supra and infra, are hereby expressly incorporated herein by reference.

Although any suitable methods and materials similar or equivalent to those described herein find use in the practice of the present invention, some methods and materials are described herein. It is to be understood that this invention is not limited to the particular methodology, protocols, and reagents described, as these may vary, depending upon the context they are used by those of skill in the art. Accordingly, the terms defined immediately below are more fully described by reference to the invention as a whole.

It is to be understood that both the foregoing general description and the following detailed description are exemplary and explanatory only and are not restrictive of the present invention. The section headings used herein are for organizational purposes only and not to be construed as limiting the subject matter described. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

Abbreviations and Definitions

The abbreviations used for the genetically encoded amino acids are conventional and are as follows: alanine (Ala or A), arginine (Are or R), asparagine (Asn or N), aspartate (Asp or D), cysteine (Cys or C), glutamate (Glu or E), glutamine (Gln or Q), histidine (His or H), isoleucine (Ile or I), leucine (Leu or L), lysine (Lys or K), methionine (Met or M), phenylalanine (Phe or F), proline (Pro or P), serine (Ser or S), threonine (Thr or T), tryptophan (Trp or W), tyrosine (Tyr or Y), and valine (Val or V).

When the three-letter abbreviations are used, unless specifically preceded by an "L" or a "D" or clear from the context in which the abbreviation is used, the amino acid may be in either the L- or D-configuration about α-carbon (Cα). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleosides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

In reference to the present invention, the technical and scientific terms used in the descriptions herein will have the meanings commonly understood by one of ordinary skill in the art, unless specifically defined otherwise. Accordingly, the following terms are intended to have the following meanings.

As used herein, the singular forms "a", "an" and "the" include plural referents unless the context clearly indicates otherwise. Thus, for example, reference to "a polypeptide" includes more than one polypeptide.

Similarly, "comprise," "comprises," "comprising" "include," "includes," and "including" are interchangeable and not intended to be limiting. Thus, as used herein, the term "comprising" and its cognates are used in their inclusive sense (i.e., equivalent to the term "including" and its corresponding cognates).

It is to be further understood that where descriptions of various embodiments use the term "comprising," those skilled in the art would understand that in some specific instances, an embodiment can be alternatively described using language "consisting essentially of" or "consisting of."

As used herein, the term "about" means an acceptable error for a particular value. In some instances, "about" means within 0.05%, 0.5%, 1.0%, or 2.0%, of a given value range. In some instances, "about" means within 1, 2, 3, or 4 standard deviations of a given value.

As used herein, "EC" number refers to the Enzyme Nomenclature of the Nomenclature Committee of the International Union of Biochemistry and Molecular Biology (NC-IUBMB). The IUBMB biochemical classification is a numerical classification system for enzymes based on the chemical reactions they catalyze.

As used herein, "ATCC" refers to the American Type Culture Collection whose biorepository collection includes genes and strains.

As used herein, "NCBI" refers to National Center for Biological Information and the sequence databases provided therein.

As used herein, "phosphopentomutase" ("PPM") enzymes are enzymes that catalyze the reversible isomerization of ribose 1-phosphate to ribose 5-phosphate and related compounds such as deoxyribose phosphate and analogs of ribose phosphate and deoxyribose phosphate. As used herein, "phosphopentomutases" may include both naturally-occurring and engineered enzymes.

As used herein, "purine nucleoside phosphorylase" ("PNP") enzymes are enzymes that catalyze the reversible phosphorlysis of purine ribonucleosides and related compounds (e.g., deoxyribonucleosides and analogs of ribonucleosides and deoxyribonucleosides) to the free purine base and ribose-1-phosphate (and analogs thereof). As used herein, "purine nucleoside phosphorylases" may include both naturally-occurring and engineered enzymes.

"Protein," "polypeptide," and "peptide" are used interchangeably herein to denote a polymer of at least two amino acids covalently linked by an amide bond, regardless of length or post-translational modification (e.g., glycosylation or phosphorylation). Included within this definition are D- and L-amino acids, and mixtures of D- and L-amino acids, as well as polymers comprising D- and L-amino acids, and mixtures of D- and L-amino acids.

"Amino acids" are referred to herein by either their commonly known three-letter symbols or by the one-letter symbols recommended by IUPAC-IUB Biochemical Nomenclature Commission. Nucleotides, likewise, may be referred to by their commonly accepted single letter codes.

As used herein, "hydrophilic amino acid or residue" refers to an amino acid or residue having a side chain exhibiting a hydrophobicity of less than zero according to the normalized consensus hydrophobicity scale of Eisenberg et al., (Eisenberg et al., J. Mol. Biol., 179:125-142 [1984]). Genetically encoded hydrophilic amino acids include L-Thr (T), L-Ser (S), L-His (H), L-Glu (E), L-Asn (N), L-Gln (Q), L-Asp (D), L-Lys (K) and L-Arg (R).

As used herein, "acidic amino acid or residue" refers to a hydrophilic amino acid or residue having a side chain exhibiting a pKa value of less than about 6 when the amino acid is included in a peptide or polypeptide. Acidic amino acids typically have negatively charged side chains at physiological pH due to loss of a hydrogen ion. Genetically encoded acidic amino acids include L-Glu (E) and L-Asp (D).

As used herein, "basic amino acid or residue" refers to a hydrophilic amino acid or residue having a side chain exhibiting a pKa value of greater than about 6 when the amino acid is included in a peptide or polypeptide. Basic amino acids typically have positively charged side chains at physiological pH due to association with hydronium ion. Genetically encoded basic amino acids include L-Arg (R) and L-Lys (K).

As used herein, "polar amino acid or residue" refers to a hydrophilic amino acid or residue having a side chain that is uncharged at physiological pH, but which has at least one bond in which the pair of electrons shared in common by two atoms is held more closely by one of the atoms. Genetically encoded polar amino acids include L-Asn (N), L-Gln (Q), L-Ser (S) and L-Thr (T).

As used herein, "hydrophobic amino acid or residue" refers to an amino acid or residue having a side chain exhibiting a hydrophobicity of greater than zero according to the normalized consensus hydrophobicity scale of Eisenberg et al., (Eisenberg et al., J. Mol. Biol., 179:125-142 [1984]). Genetically encoded hydrophobic amino acids include L-Pro (P), L-Ile (I), L-Phe (F), L-Val (V), L-Leu (L), L-Trp (W), L-Met (M), L-Ala (A) and L-Tyr (Y).

As used herein, "aromatic amino acid or residue" refers to a hydrophilic or hydrophobic amino acid or residue having a side chain that includes at least one aromatic or heteroaromatic ring. Genetically encoded aromatic amino acids include L-Phe (F), L-Tyr (Y) and L-Trp (W). Although owing to the pKa of its heteroaromatic nitrogen atom L-His (H) it is sometimes classified as a basic residue, or as an aromatic residue as its side chain includes a heteroaromatic ring, herein histidine is classified as a hydrophilic residue or as a "constrained residue" (see below).

As used herein, "constrained amino acid or residue" refers to an amino acid or residue that has a constrained geometry. Herein, constrained residues include L-Pro (P) and L-His (H). Histidine has a constrained geometry because it has a relatively small imidazole ring. Proline has a constrained geometry because it also has a five membered ring.

As used herein, "non-polar amino acid or residue" refers to a hydrophobic amino acid or residue having a side chain that is uncharged at physiological pH and which has bonds in which the pair of electrons shared in common by two atoms is generally held equally by each of the two atoms (i.e., the side chain is not polar). Genetically encoded non-polar amino acids include L-Gly (G), L-Leu (L), L-Val (V), L-Ile (I), L-Met (M) and L-Ala (A).

As used herein, "aliphatic amino acid or residue" refers to a hydrophobic amino acid or residue having an aliphatic hydrocarbon side chain. Genetically encoded aliphatic amino acids include L-Ala (A), L-Val (V), L-Leu (L) and L-Ile (I). It is noted that cysteine (or "L-Cys" or "[C]") is unusual in that it can form disulfide bridges with other L-Cys (C) amino acids or other sulfanyl- or sulfhydryl-containing amino acids. The "cysteine-like residues" include cysteine and other amino acids that contain sulfhydryl moieties that are available for formation of disulfide bridges. The ability of L-Cys (C) (and other amino acids with —SH containing side chains) to exist in a peptide in either the reduced free —SH or oxidized disulfide-bridged form affects whether L-Cys (C) contributes net hydrophobic or hydrophilic character to a peptide. While L-Cys (C) exhibits a hydrophobicity of 0.29 according to the normalized consensus scale of Eisenberg (Eisenberg et al., 1984, supra), it is to be understood that for purposes of the present disclosure, L-Cys (C) is categorized into its own unique group.

As used herein, "small amino acid or residue" refers to an amino acid or residue having a side chain that is composed of a total three or fewer carbon and/or heteroatoms (excluding the α-carbon and hydrogens). The small amino acids or residues may be further categorized as aliphatic, non-polar, polar or acidic small amino acids or residues, in accordance with the above definitions. Genetically-encoded small amino acids include L-Ala (A), L-Val (V), L-Cys (C), L-Asn (N), L-Ser (S), L-Thr (T) and L-Asp (D).

As used herein, "hydroxyl-containing amino acid or residue" refers to an amino acid containing a hydroxyl (—OH) moiety. Genetically-encoded hydroxyl-containing amino acids include L-Ser (S) L-Thr (T) and L-Tyr (Y).

As used herein, "polynucleotide" and "nucleic acid" refer to two or more nucleotides that are covalently linked together. The polynucleotide may be wholly comprised of ribonucleotides (i.e., RNA), wholly comprised of 2' deoxyribonucleotides (i.e., DNA), or comprised of mixtures of ribo- and 2' deoxyribonucleotides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. In some embodiments, such modified or synthetic nucleobases are nucleobases encoding amino acid sequences.

As used herein, "nucleoside" refers to glycosylamines comprising a nucleobase (i.e., a nitrogenous base), and a 5-carbon sugar (e.g., ribose or deoxyribose). Non-limiting examples of nucleosides include cytidine, uridine, adenosine, guanosine, thymidine, and inosine. In contrast, the term "nucleotide" refers to the glycosylamines comprising a nucleobase, a 5-carbon sugar, and one or more phosphate groups. In some embodiments, nucleosides can be phosphorylated by kinases to produce nucleotides.

As used herein, "nucleoside diphosphate" refers to glycosylamines comprising a nucleobase (i.e., a nitrogenous base), a 5-carbon sugar (e.g., ribose or deoxyribose), and a diphosphate (i.e., pyrophosphate) moiety. In some embodiments herein, "nucleoside diphosphate" is abbreviated as "NDP". Non-limiting examples of nucleoside diphosphates include cytidine diphosphate (CDP), uridine diphosphate (UDP), adenosine diphosphate (ADP), guanosine diphosphate (GDP), thymidine diphosphate (TDP), and inosine diphosphate (IDP). The terms "nucleoside" and "nucleotide" may be used interchangeably in some contexts.

As used herein, "coding sequence" refers to that portion of a nucleic acid (e.g., a gene) that encodes an amino acid sequence of a protein.

As used herein, the terms "biocatalysis," "biocatalytic," "biotransformation," and "biosynthesis" refer to the use of enzymes to perform chemical reactions on organic compounds.

As used herein, "wild-type" and "naturally-occurring" refer to the form found in nature. For example, a wild-type polypeptide or polynucleotide sequence is a sequence present in an organism that can be isolated from a source in nature and which has not been intentionally modified by human manipulation.

As used herein, "recombinant," "engineered," "variant," and "non-naturally occurring" when used with reference to a cell, nucleic acid, or polypeptide, refers to a material, or a material corresponding to the natural or native form of the material, that has been modified in a manner that would not otherwise exist in nature. In some embodiments, the cell, nucleic acid or polypeptide is identical a naturally occurring cell, nucleic acid or polypeptide, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

The term "percent (%) sequence identity" is used herein to refer to comparisons among polynucleotides or polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted by any suitable method, including, but not limited to the local homology algorithm of Smith and Waterman (Smith and Waterman, Adv. Appl. Math., 2:482 [1981]), by the homology alignment algorithm of Needleman and Wunsch (Needleman and Wunsch, J. Mol. Biol., 48:443 [1970]), by the search for similarity method of Pearson and Lipman (Pearson and Lipman, Proc. Natl. Acad. Sci. USA 85:2444 [1988]), by computerized implementations of these algorithms (e.g., GAP, BESTFIT, FASTA, and TFASTA in the GCG Wisconsin Software Package), or by visual inspection, as known in the art. Examples of algorithms that are suitable for determining percent sequence identity and sequence similarity include, but are not limited to the BLAST and BLAST 2.0 algorithms, which are described by Altschul et al. (See Altschul et al., J. Mol. Biol., 215: 403-410 [1990]; and Altschul et al., Nucl. Acids Res., 3389-3402 [1977], respectively). Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (See, Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a word length (W) of 3, an expectation (E) of 10, and the BLOSUM62 scoring matrix (See, Henikoff and Henikoff, Proc. Natl. Acad. Sci. USA 89:10915 [1989]). Exemplary determination of sequence alignment and % sequence identity can employ the BESTFIT or GAP programs in the GCG Wisconsin Software package (Accelrys, Madison WI), using default parameters provided.

As used herein, "reference sequence" refers to a defined sequence used as a basis for a sequence and/or activity comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, at least 100 residues in length or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptides are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence.

As used herein, "comparison window" refers to a conceptual segment of at least about 20 contiguous nucleotide positions or amino acid residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "corresponding to," "reference to," and "relative to" when used in the context of the numbering of a given amino acid or polynucleotide sequence refer to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered phosphopentomutase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

As used herein, "substantial identity" refers to a polynucleotide or polypeptide sequence that has at least 80 percent sequence identity, at least 85 percent identity, at least between 89 to 95 percent sequence identity, or more usually, at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In some specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some embodiments, residue positions that are not identical in sequences being compared differ by conservative amino acid substitutions.

As used herein, "amino acid difference" and "residue difference" refer to a difference in the amino acid residue at a position of a polypeptide sequence relative to the amino acid residue at a corresponding position in a reference sequence. In some cases, the reference sequence has a histidine tag, but the numbering is maintained relative to the equivalent reference sequence without the histidine tag. The positions of amino acid differences generally are referred to herein as "Xn," where n refers to the corresponding position in the reference sequence upon which the residue difference is based. For example, a "residue difference at position X93 as compared to SEQ ID NO:4" refers to a difference of the amino acid residue at the polypeptide position corresponding to position 93 of SEQ ID NO:4. Thus, if the reference polypeptide of SEQ ID NO:4 has a serine at position 93, then a "residue difference at position X93 as compared to SEQ ID NO:4" an amino acid substitution of any residue other than serine at the position of the polypeptide corresponding to position 93 of SEQ ID NO:4. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances (e.g., in the Tables presented in the Examples), the present invention also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present invention can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "I" (e.g., X307H/X307P or X307H/P). The slash may also be used to indicate multiple substitutions within a given variant (i.e., there is more than one substitution present in a given sequence, such as in a combinatorial variant). In some embodiments, the present invention includes engineered polypeptide sequences comprising one or more amino acid differences comprising conservative or non-conservative amino acid substitutions. In some additional embodiments, the present invention provides engineered polypeptide sequences comprising both conservative and non-conservative amino acid substitutions.

As used herein, "conservative amino acid substitution" refers to a substitution of a residue with a different residue having a similar side chain, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with an hydroxyl side chain is substituted with another amino acid with an hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively.

As used herein, "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered phosphopentomutase enzyme. Deletions can be directed to the internal portions and/or terminal portions of the polypeptide. In various embodiments, the deletion can comprise a continuous segment or can be discontinuous. Deletions are typically indicated by "-" in amino acid sequences.

As used herein, "insertion" refers to modification to the polypeptide by addition of one or more amino acids from the reference polypeptide. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

The term "amino acid substitution set" or "substitution set" refers to a group of amino acid substitutions in a polypeptide sequence, as compared to a reference sequence. A substitution set can have 1, 2, 3, 4, 5, 6, 7, 8, 9, 10, 11, 12, 13, 14, 15, or more amino acid substitutions. In some embodiments, a substitution set refers to the set of amino acid substitutions that is present in any of the variant phosphopentomutases listed in the Tables provided in the Examples.

A "functional fragment" and "biologically active fragment" are used interchangeably herein to refer to a polypeptide that has an amino-terminal and/or carboxy-terminal deletion(s) and/or internal deletions, but where the remaining amino acid sequence is identical to the corresponding positions in the sequence to which it is being compared (e.g., a full-length engineered phosphopentomutase of the present invention) and that retains substantially all of the activity of the full-length polypeptide.

As used herein, "isolated polypeptide" refers to a polypeptide which is substantially separated from other contaminants that naturally accompany it (e.g., protein, lipids, and polynucleotides). The term embraces polypeptides which have been removed or purified from their naturally-occurring environment or expression system (e.g., within a host cell or via in vitro synthesis). The recombinant phosphopentomutase polypeptides may be present within a cell, present in the cellular medium, or prepared in various forms, such as lysates or isolated preparations. As such, in some embodiments, the recombinant phosphopentomutase polypeptides can be an isolated polypeptide.

As used herein, "substantially pure polypeptide" or "purified protein" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. However, in some embodiments, the composition comprising phosphopentomutase comprises phosphopentomutase that is less than 50% pure (e.g., about 10%, about 20%, about 30%, about 40%, or about 50%) Generally, a substantially pure phosphopentomutase composition comprises about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated recombinant phosphopentomutase polypeptides are substantially pure polypeptide compositions.

As used herein, "improved enzyme property" refers to at least one improved property of an enzyme. In some embodiments, the present invention provides engineered phosphopentomutase polypeptides that exhibit an improvement in any enzyme property as compared to a reference phosphopentomutase polypeptide and/or a wild-type phosphopentomutase polypeptide, and/or another engineered phosphopentomutase polypeptide. Thus, the level of "improvement" can be determined and compared between various phosphopentomutase polypeptides, including wild-type, as well as engineered phosphopentomutases. Improved properties include, but are not limited, to such properties as increased protein expression, increased thermoactivity, increased thermostability, increased pH activity, increased stability, increased enzymatic activity, increased substrate specificity or affinity, increased specific activity, increased resistance to substrate or end-product inhibition, increased chemical stability, improved chemoselectivity, improved solvent stability, increased tolerance to acidic pH, increased tolerance to proteolytic activity (i.e., reduced sensitivity to proteolysis), reduced aggregation, increased solubility, and altered temperature profile. In additional embodiments, the term is used in reference to the at least one improved property of phosphopentomutase enzymes. In some embodiments, the present invention provides engineered phosphopentomutase polypeptides that exhibit an improvement in any enzyme property as compared to a reference phosphopentomutase polypeptide and/or a wild-type phosphopentomutase polypeptide, and/or another engineered phosphopentomutase polypeptide. Thus, the level of "improvement" can be determined and compared between various phosphopentomutase polypeptides, including wild-type, as well as engineered phosphopentomutases.

As used herein, "increased enzymatic activity" and "enhanced catalytic activity" refer to an improved property of the engineered polypeptides, which can be represented by an increase in specific activity (e.g., product produced/time/weight protein) or an increase in percent conversion of the substrate to the product (e.g., percent conversion of starting amount of substrate to product in a specified time period using a specified amount of enzyme) as compared to the reference enzyme. In some embodiments, the terms refer to an improved property of engineered phosphopentomutase polypeptides provided herein, which can be represented by an increase in specific activity (e.g., product produced/time/weight protein) or an increase in percent conversion of the substrate to the product (e.g., percent conversion of starting amount of substrate to product in a specified time period using a specified amount of phosphopentomutase) as compared to the reference phosphopentomutase enzyme. In some embodiments, the terms are used in reference to improved phosphopentomutase enzymes provided herein. Exemplary methods to determine enzyme activity of the engineered phosphopentomutases of the present invention are provided in the Examples. Any property relating to enzyme activity may be affected, including the classical enzyme properties of $K_m$, $V_{max}$ or $k_{cat}$, changes of which can lead to increased enzymatic activity. For example, improvements in enzyme activity can be from about 1.1 fold the enzymatic activity of the corresponding wild-type enzyme, to as much as 2-fold, 5-fold, 10-fold, 20-fold, 25-fold, 50-fold, 75-fold, 100-fold, 150-fold, 200-fold or more enzymatic activity than the naturally occurring phosphopentomutase or another engineered phosphopentomutase from which the phosphopentomutase polypeptides were derived.

As used herein, "conversion" refers to the enzymatic conversion (or biotransformation) of a substrate(s) to the corresponding product(s). "Percent conversion" refers to the percent of the substrate that is converted to the product within a period of time under specified conditions. Thus, the "enzymatic activity" or "activity" of a phosphopentomutase polypeptide can be expressed as "percent conversion" of the substrate to the product in a specific period of time.

Enzymes with "generalist properties" (or "generalist enzymes") refer to enzymes that exhibit improved activity for a wide range of substrates, as compared to a parental sequence. Generalist enzymes do not necessarily demonstrate improved activity for every possible substrate. In some embodiments, the present invention provides phosphopentomutase variants with generalist properties, in that they demonstrate similar or improved activity relative to the parental gene for a wide range of sterically and electronically diverse substrates. In addition, the generalist enzymes provided herein were engineered to be improved across a wide range of diverse molecules to increase the production of metabolites/products.

The term "stringent hybridization conditions" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (See e.g., Baldino et al., Meth. Enzymol., 168:761-777 [1989]; Bolton et al., Proc. Natl. Acad. Sci. USA 48:1390 [1960]; Bresslauer et al., Proc. Natl. Acad. Sci. USA 83:8893-8897 [1986]; Freier et al., Proc. Natl. Acad. Sci. USA 83:9373-9377 [1986]; Kierzek et al., Biochem., 25:7840-7846 [1986]; Rychlik et al., Nucl. Acids Res., 18:6409-6412 [1990] (erratum, Nucl. Acids Res., 19:698 [1991]); Sambrook et al., supra); Suggs et al., 1981, in *Developmental Biology Using Purified Genes*, Brown et al. [eds.], pp. 683-693, Academic Press, Cambridge, MA [1981]; and Wetmur, Crit. Rev. Biochem. Mol. Biol. 26:227-259 [1991]). In some embodiments, the polynucleotide encodes the polypeptide disclosed herein and hybridizes under defined conditions, such as moderately stringent or highly stringent conditions, to the complement of a sequence encoding an engineered phosphopentomutase enzyme of the present invention.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w/v) SDS at 65° C. and washing in 0.1×SSC containing 0.1% SDS at 65° C. Other high stringency hybridization conditions, as well as moderately stringent conditions, are described in the references cited above.

As used herein, "codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the phosphopentomutase enzymes may be codon optimized for optimal production in the host organism selected for expression.

As used herein, "preferred," "optimal," and "high codon usage bias" codons when used alone or in combination refer(s) interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, Peden, University of Nottingham; McInerney, Bioinform., 14:372-73 [1998]; Stenico et al., Nucl. Acids Res., 222437-46 [1994]; and Wright, Gene 87:23-29 [1990]). Codon usage tables are available for many different organisms (See e.g., Wada et al., Nucl. Acids Res., 20:2111-2118 [1992]; Nakamura et al., Nucl. Acids Res., 28:292 [2000]; Duret, et al., supra; Henaut and Danchin, in *Escherichia coli and Salmonella*, Neidhardt, et al. (eds.), ASM Press, Washington D.C., p. 2047-2066 [1996]). The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Mount, *Bioinformatics: Sequence and Genome Analysis*, Chapter 8, Cold Spring Harbor Laboratory Press, Cold Spring Harbor, N.Y. [2001]; Uberbacher, Meth. Enzymol., 266:259-281 [1996]; and Tiwari et al., Comput. Appl. Biosci., 13:263-270 [1997]).

As used herein, "control sequence" includes all components, which are necessary or advantageous for the expression of a polynucleotide and/or polypeptide of the present invention. Each control sequence may be native or foreign to the nucleic acid sequence encoding the polypeptide. Such control sequences include, but are not limited to, a leader, polyadenylation sequence, propeptide sequence, promoter sequence, signal peptide sequence, initiation sequence and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

The phrase "suitable reaction conditions" refers to those conditions in the enzymatic conversion reaction solution (e.g., ranges of enzyme loading, substrate loading, temperature, pH, buffers, co-solvents, etc.) under which a phosphopentomutase polypeptide of the present invention is capable of converting a substrate to the desired product compound. Some exemplary "suitable reaction conditions" are provided herein.

As used herein, "loading," such as in "compound loading" or "enzyme loading" refers to the concentration or amount of a component in a reaction mixture at the start of the reaction.

As used herein, "substrate" in the context of an enzymatic conversion reaction process refers to the compound or molecule acted on by the engineered enzymes provided herein (e.g., engineered phosphopentomutase polypeptides).

As used herein, "increasing" yield of a product (e.g., a deoxyribose phosphate analog) from a reaction occurs when a particular component present during the reaction (e.g., a phosphopentomutase enzyme) causes more product to be produced, compared with a reaction conducted under the same conditions with the same substrate and other substituents, but in the absence of the component of interest.

A reaction is said to be "substantially free" of a particular enzyme if the amount of that enzyme compared with other enzymes that participate in catalyzing the reaction is less than about 2%, about 1%, or about 0.1% (wt/wt).

As used herein, "fractionating" a liquid (e.g., a culture broth) means applying a separation process (e.g., salt precipitation, column chromatography, size exclusion, and filtration) or a combination of such processes to provide a solution in which a desired protein comprises a greater percentage of total protein in the solution than in the initial liquid product.

As used herein, "starting composition" refers to any composition that comprises at least one substrate. In some embodiments, the starting composition comprises any suitable substrate.

As used herein, “product” in the context of an enzymatic conversion process refers to the compound or molecule resulting from the action of an enzymatic polypeptide on a substrate.

As used herein, “equilibration” as used herein refers to the process resulting in a steady state concentration of chemical species in a chemical or enzymatic reaction (e.g., interconversion of two species A and B), including interconversion of stereoisomers, as determined by the forward rate constant and the reverse rate constant of the chemical or enzymatic reaction.

As used herein, “alkyl” refers to saturated hydrocarbon groups of from 1 to 18 carbon atoms inclusively, either straight chained or branched, more preferably from 1 to 8 carbon atoms inclusively, and most preferably 1 to 6 carbon atoms inclusively. An alkyl with a specified number of carbon atoms is denoted in parenthesis (e.g., (C1-C4)alkyl refers to an alkyl of 1 to 4 carbon atoms).

As used herein, “alkenyl” refers to groups of from 2 to 12 carbon atoms inclusively, either straight or branched containing at least one double bond but optionally containing more than one double bond.

As used herein, “alkynyl” refers to groups of from 2 to 12 carbon atoms inclusively, either straight or branched containing at least one triple bond but optionally containing more than one triple bond, and additionally optionally containing one or more double bonded moieties.

As used herein, “heteroalkyl, “heteroalkenyl,” and heteroalkynyl,” refer to alkyl, alkenyl and alkynyl as defined herein in which one or more of the carbon atoms are each independently replaced with the same or different heteroatoms or heteroatomic groups. Heteroatoms and/or heteroatomic groups which can replace the carbon atoms include, but are not limited to, —O—, —S—, —S—O—, —NRα—, —PH—, —S(O)—, —$S(O)_2$—, —S(O) NRα-, —$S(O)_2$NRα-, and the like, including combinations thereof, where each Ra is independently selected from hydrogen, alkyl, heteroalkyl, cycloalkyl, heterocycloalkyl, aryl, and heteroaryl.

As used herein, “alkoxy” refers to the group —ORβ wherein Rβ is an alkyl group is as defined above including optionally substituted alkyl groups as also defined herein.

As used herein, “aryl” refers to an unsaturated aromatic carbocyclic group of from 6 to 12 carbon atoms inclusively having a single ring (e.g., phenyl) or multiple condensed rings (e.g., naphthyl or anthryl). Exemplary aryls include phenyl, pyridyl, naphthyl and the like.

As used herein, “amino” refers to the group —NH2. Substituted amino refers to the group —NHRδ, NRδRδ, and NRδRδRδ, where each Rδ is independently selected from substituted or unsubstituted alkyl, cycloalkyl, cycloheteroalkyl, alkoxy, aryl, heteroaryl, heteroarylalkyl, acyl, alkoxycarbonyl, sulfanyl, sulfanyl, sulfonyl, and the like. Typical amino groups include, but are limited to, dimethylamino, diethylamino, trimethylammonium, triethylammonium, methylysulfonylamino, furanyl-oxy-sulfamino, and the like.

As used herein, “oxo” refers to ═O.

As used herein, “oxy” refers to a divalent group —O—, which may have various substituents to form different oxy groups, including ethers and esters.

As used herein, “carboxy” refers to —COOH.

As used herein, “carbonyl” refers to —C(O)—, which may have a variety of substituents to form different carbonyl groups including acids, acid halides, aldehydes, amides, esters, and ketones.

As used herein, “alkyloxycarbonyl” refers to —C(O)ORε, where Re is an alkyl group as defined herein, which can be optionally substituted.

As used herein, “aminocarbonyl” refers to —C(O)$NH_2$. Substituted aminocarbonyl refers to —C(O)NRδRδ, where the amino group NRδRδ is as defined herein.

As used herein, “halogen” and “halo” refer to fluoro, chloro, bromo and iodo.

As used herein, “hydroxy” refers to —OH.

As used herein, “cyano” refers to —CN.

As used herein, “heteroaryl” refers to an aromatic heterocyclic group of from 1 to 10 carbon atoms inclusively and 1 to 4 heteroatoms inclusively selected from oxygen, nitrogen and sulfur within the ring. Such heteroaryl groups can have a single ring (e.g., pyridyl or furyl) or multiple condensed rings (e.g., indolizinyl or benzothienyl).

As used herein, “heteroarylalkyl” refers to an alkyl substituted with a heteroaryl (i.e., heteroaryl-alkyl-groups), preferably having from 1 to 6 carbon atoms inclusively in the alkyl moiety and from 5 to 12 ring atoms inclusively in the heteroaryl moiety. Such heteroarylalkyl groups are exemplified by pyridylmethyl and the like.

As used herein, “heteroarylalkenyl” refers to an alkenyl substituted with a heteroaryl (i.e., heteroaryl-alkenyl-groups), preferably having from 2 to 6 carbon atoms inclusively in the alkenyl moiety and from 5 to 12 ring atoms inclusively in the heteroaryl moiety.

As used herein, “heteroarylalkynyl” refers to an alkynyl substituted with a heteroaryl (i.e., heteroaryl-alkynyl-groups), preferably having from 2 to 6 carbon atoms inclusively in the alkynyl moiety and from 5 to 12 ring atoms inclusively in the heteroaryl moiety.

As used herein, “heterocycle,” “heterocyclic,” and interchangeably “heterocycloalkyl,” refer to a saturated or unsaturated group having a single ring or multiple condensed rings, from 2 to 10 carbon ring atoms inclusively and from 1 to 4 hetero ring atoms inclusively selected from nitrogen, sulfur or oxygen within the ring. Such heterocyclic groups can have a single ring (e.g., piperidinyl or tetrahydrofuryl) or multiple condensed rings (e.g., indolinyl, dihydrobenzofuran or quinuclidinyl). Examples of heterocycles include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, imidazoline, piperidine, piperazine, pyrrolidine, indoline and the like.

As used herein, “membered ring” is meant to embrace any cyclic structure. The number preceding the term “membered” denotes the number of skeletal atoms that constitute the ring. Thus, for example, cyclohexyl, pyridine, pyran and thiopyran are 6-membered rings and cyclopentyl, pyrrole, furan, and thiophene are 5-membered rings.

Unless otherwise specified, positions occupied by hydrogen in the foregoing groups can be further substituted with substituents exemplified by, but not limited to, hydroxy, oxo, nitro, methoxy, ethoxy, alkoxy, substituted alkoxy, trifluoromethoxy, haloalkoxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkoxyalkyl, thio, alkylthio, acyl, carboxy, alkoxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; and preferred heteroatoms are oxygen, nitrogen, and sulfur. It is understood that where open valences exist on these substituents they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further understood that the above substitutions can be made provided that replacing the hydrogen with the substituent does not introduce unacceptable instability to the molecules of the present invention, and is otherwise chemically reasonable.

As used herein the term "culturing" refers to the growing of a population of microbial cells under any suitable conditions (e.g., using a liquid, gel or solid medium).

Recombinant polypeptides can be produced using any suitable methods known in the art. Genes encoding the wild-type polypeptide of interest can be cloned in vectors, such as plasmids, and expressed in desired hosts, such as *E. coli*, etc. Variants of recombinant polypeptides can be generated by various methods known in the art. Indeed, there is a wide variety of different mutagenesis techniques well known to those skilled in the art. In addition, mutagenesis kits are also available from many commercial molecular biology suppliers. Methods are available to make specific substitutions at defined amino acids (site-directed), specific or random mutations in a localized region of the gene (regio-specific), or random mutagenesis over the entire gene (e.g., saturation mutagenesis). Numerous suitable methods are known to those in the art to generate enzyme variants, including but not limited to site-directed mutagenesis of single-stranded DNA or double-stranded DNA using PCR, cassette mutagenesis, gene synthesis, error-prone PCR, shuffling, and chemical saturation mutagenesis, or any other suitable method known in the art. Mutagenesis and directed evolution methods can be readily applied to enzyme-encoding polynucleotides to generate variant libraries that can be expressed, screened, and assayed. Any suitable mutagenesis and directed evolution methods find use in the present invention and are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related US, as well as PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229:1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the enzyme clones obtained following mutagenesis treatment are screened by subjecting the enzyme preparations to a defined temperature (or other assay conditions) and measuring the amount of enzyme activity remaining after heat treatments or other suitable assay conditions. Clones containing a polynucleotide encoding a polypeptide are then isolated from the gene, sequenced to identify the nucleotide sequence changes (if any), and used to express the enzyme in a host cell. Measuring enzyme activity from the expression libraries can be performed using any suitable method known in the art (e.g., standard biochemistry techniques, such as HPLC analysis).

After the variants are produced, they can be screened for any desired property (e.g., high or increased activity, or low or reduced activity, increased thermal activity, increased thermal stability, and/or acidic pH stability, etc.). In some embodiments, "recombinant phosphopentomutase polypeptides" (also referred to herein as "engineered phosphopentomutase polypeptides," "variant phosphopentomutase enzymes," "phosphopentomutase variants," and "phosphopentomutase combinatorial variants") find use. In some embodiments, "recombinant phosphopentomutase polypeptides" (also referred to as "engineered phosphopentomutase polypeptides," "variant phosphopentomutase enzymes," "phosphopentomutase variants," and "phosphopentomutase combinatorial variants") find use.

As used herein, a "vector" is a DNA construct for introducing a DNA sequence into a cell. In some embodiments, the vector is an expression vector that is operably linked to a suitable control sequence capable of effecting the expression in a suitable host of the polypeptide encoded in the DNA sequence. In some embodiments, an "expression vector" has a promoter sequence operably linked to the DNA sequence (e.g., transgene) to drive expression in a host cell, and in some embodiments, also comprises a transcription terminator sequence.

As used herein, the term "expression" includes any step involved in the production of the polypeptide including, but not limited to, transcription, post-transcriptional modification, translation, and post-translational modification. In some embodiments, the term also encompasses secretion of the polypeptide from a cell.

As used herein, the term "produces" refers to the production of proteins and/or other compounds by cells. It is intended that the term encompass any step involved in the production of polypeptides including, but not limited to, transcription, post-transcriptional modification, translation, and post-translational modification. In some embodiments, the term also encompasses secretion of the polypeptide from a cell.

As used herein, an amino acid or nucleotide sequence (e.g., a promoter sequence, signal peptide, terminator sequence, etc.) is "heterologous" to another sequence with which it is operably linked if the two sequences are not associated in nature. For example, a "heterologous polynucleotide" is any polynucleotide that is introduced into a host cell by laboratory techniques, and includes polynucleotides that are removed from a host cell, subjected to laboratory manipulation, and then reintroduced into a host cell.

As used herein, the terms "host cell" and "host strain" refer to suitable hosts for expression vectors comprising DNA provided herein (e.g., the polynucleotides encoding the phosphopentomutase variants). In some embodiments, the host cells are prokaryotic or eukaryotic cells that have been transformed or transfected with vectors constructed using recombinant DNA techniques as known in the art.

The term "analogue" means a polypeptide having more than 70% sequence identity but less than 100% sequence identity (e.g., more than 75%, 78%, 80%, 83%, 85%, 88%, 90%, 91%, 92%, 93%, 94%, 95%, 96%, 97%, 98%, 99% sequence identity) with a reference polypeptide. In some embodiments, analogues means polypeptides that contain one or more non-naturally occurring amino acid residues including, but not limited, to homoarginine, ornithine and norvaline, as well as naturally occurring amino acids. In some embodiments, analogues also include one or more D-amino acid residues and non-peptide linkages between two or more amino acid residues.

The term "effective amount" means an amount sufficient to produce the desired result. One of general skill in the art may determine what the effective amount by using routine experimentation.

The terms "isolated" and "purified" are used to refer to a molecule (e.g., an isolated nucleic acid, polypeptide, etc.) or other component that is removed from at least one other component with which it is naturally associated. The term "purified" does not require absolute purity, rather it is intended as a relative definition.

As used herein, "stereoselectivity" refers to the preferential formation in a chemical or enzymatic reaction of one stereoisomer over another. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess ("e.e.") calculated therefrom according to the formula [major enantiomer—minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess ("d.e."). Enantiomeric excess and diastereomeric excess are types of stereomeric excess.

As used herein, "regioselectivity" and "regioselective reaction" refer to a reaction in which one direction of bond making or breaking occurs preferentially over all other possible directions. Reactions can completely (100%) regioselective if the discrimination is complete, substantially regioselective (at least 75%), or partially regioselective (x %, wherein the percentage is set dependent upon the reaction of interest), if the product of reaction at one site predominates over the product of reaction at other sites.

As used herein, "chemoselectivity" refers to the preferential formation in a chemical or enzymatic reaction of one product over another.

As used herein, "pH stable" refers to a phosphopentomutase polypeptide that maintains similar activity (e.g., more than 60% to 80%) after exposure to high or low pH (e.g., 4.5-6 or 8 to 12) for a period of time (e.g., 0.5-24 hrs) compared to the untreated enzyme.

As used herein, "thermostable" refers to a phosphopentomutase polypeptide that maintains similar activity (more than 60% to 80% for example) after exposure to elevated temperatures (e.g., 40-80° C.) for a period of time (e.g., 0.5-24 h) compared to the wild-type enzyme exposed to the same elevated temperature.

As used herein, "solvent stable" refers to a phosphopentomutase polypeptide that maintains similar activity (more than e.g., 60% to 80%) after exposure to varying concentrations (e.g., 5-99%) of solvent (ethanol, isopropyl alcohol, dimethylsulfoxide [DMSO], tetrahydrofuran, 2-methyltetrahydrofuran, acetone, toluene, butyl acetate, methyl tert-butyl ether, etc.) for a period of time (e.g., 0.5-24 h) compared to the wild-type enzyme exposed to the same concentration of the same solvent.

As used herein, "thermo- and solvent stable" refers to a phosphopentomutase polypeptide that is both thermostable and solvent stable.

As used herein, "optional" and "optionally" mean that the subsequently described event or circumstance may or may not occur, and that the description includes instances where the event or circumstance occurs and instances in which it does not. One of ordinary skill in the art would understand that with respect to any molecule described as containing one or more optional substituents, only sterically practical and/or synthetically feasible compounds are meant to be included.

As used herein, "optionally substituted" refers to all subsequent modifiers in a term or series of chemical groups. For example, in the term "optionally substituted arylalkyl, the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

DETAILED DESCRIPTION OF THE INVENTION

The present invention provides engineered phosphopentomutase (PPM) enzymes, polypeptides having PPM activity, and polynucleotides encoding these enzymes, as well as vectors and host cells comprising these polynucleotides and polypeptides. Methods for producing PPM enzymes are also provided. The present invention further provides compositions comprising the PPM enzymes and methods of using the engineered PPM enzymes. The present invention finds particular use in the production of pharmaceutical compounds.

In some embodiments, the present invention provides enzymes suitable for the production of nucleoside analogues such as MK-8591 (Merck). The present invention was developed in order to address the potential use of enzymes to produce these nucleoside analogues. However, it was determined that one challenge with this approach is that wild-type enzymes are unlikely to be optimal for the required substrate analogues required for the production of all the required intermediates. In addition, each enzyme in the synthetic pathway requires some engineering to make it compatible with the surrogate substrate and the process used in the synthesis of the desired nucleoside analogue.

In some embodiments, the present invention provides enzymes that are useful in producing compounds that eventually result in methods for the in vitro enzymatic synthesis of the non-natural nucleoside analog shown of compound (1) (MK-8591).

Compound (1)

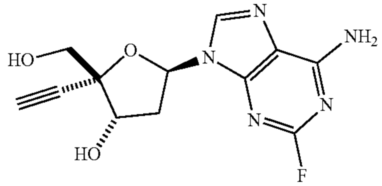

Non-natural nucleosides are essential building blocks for many important classes of drugs including those for the treatment of cancer and viral infections. There are at least a dozen nucleoside analog drugs on the market or in clinical trials (Jordheim et al., Nat. Rev. Drug Discovery 12:447-464 [2013]). One method to make compound (1) is by the purine nucleoside phosphorylase (PNP) catalyzed coupling of the ethynyl ribose-1-phosphate, compound (3), and fluoroadenine, compound (2), as shown in Scheme I.

Deoxyribose-1-phosphate compounds, such as compound (3), can be difficult to make. However, the corresponding deoxyribose-5-phosphate compounds can be made via the coupling of acetaldehyde and D-glyceraldehyde-3-phosphate (or an analog thereof) catalyzed by the enzyme 2-deoxyrbose-5-phosphate aldolase (DERA) (Barbas et al., J. Am. Chem. Soc. 112:2013-2014 [1990]). Once the deoxyribose-5-phosphate analog (4) is formed, it can be converted, or isomerized, into the corresponding deoxyribose-1-phosphate analog (3) needed for Scheme I by the action of the enzyme phosphopentomutase (PPM) as shown in Scheme II, below.

Scheme II. Reaction Catalyzed by Phosphopentomutase (PPM)

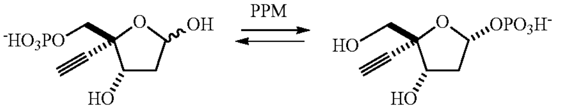

(4) (3)

The equilibrium position of the PNP and PPM reactions shown in Scheme I typically favors the reactants (compounds (2) and (4)) and not the products (compound (1) and inorganic phosphate). One way to drive the reaction to higher conversion is to remove the inorganic phosphate that is formed in the coupling step. This can be accomplished by reacting the inorganic phosphate with a disaccharide, such as sucrose, catalyzed by the enzyme sucrose phosphorylase (SP) (See e.g., U.S. Pat. No. 7,229,797). This reaction, which produces glucose-1-phosphate and fructose, is highly favorable and can drive the overall reaction as shown in Scheme III, below.

Scheme I.

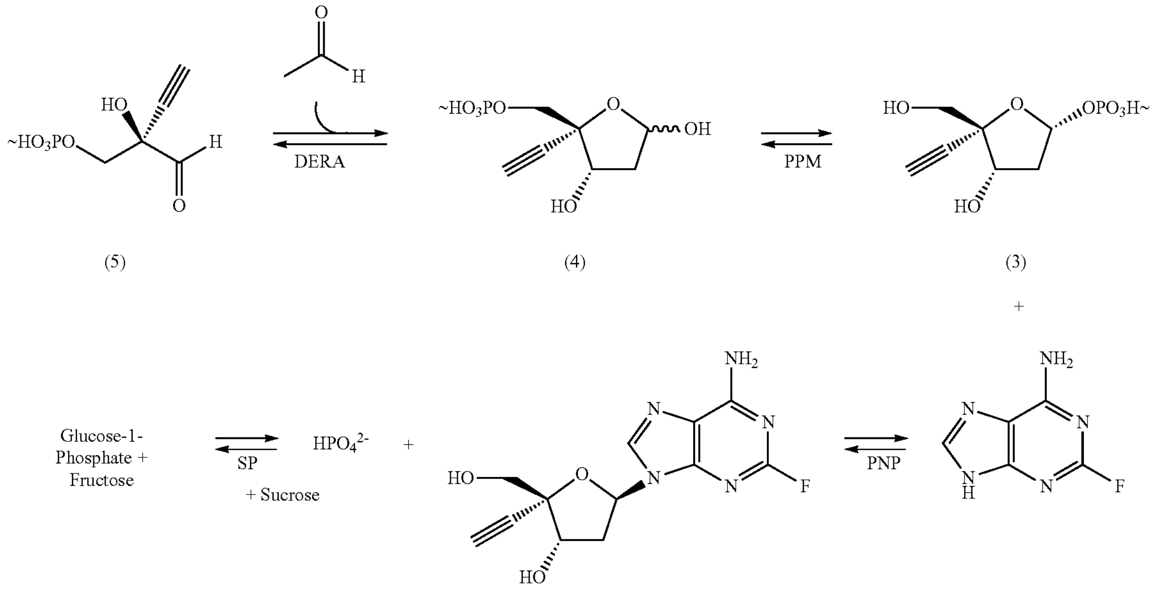

(5) (4) (3)

(1) (2)

Scheme III. Overall Reaction Scheme to Produce Compound (1)

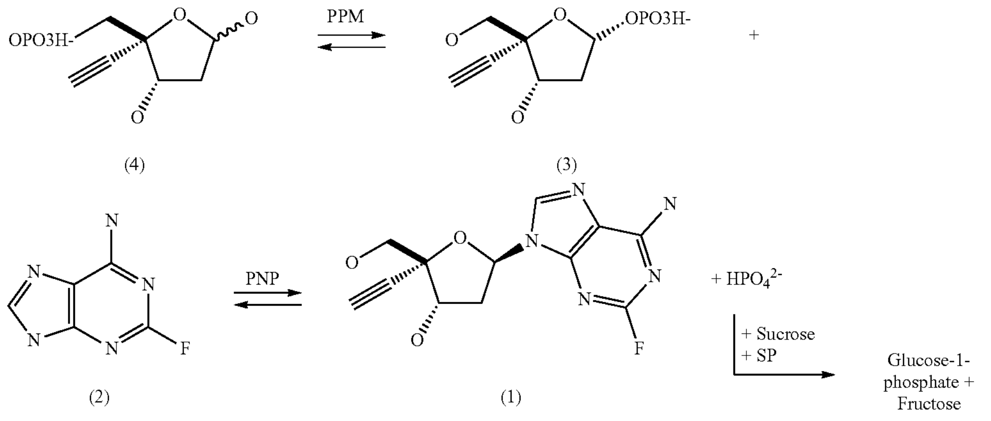

(4) (3) (2) (1)

Phosphopentomutase enzymes have been isolated and/or recombinantly expressed from a number of sources including *E. coli* (Barbas and Wong, Bioorg. Chem. 19:261-269 [1991]), *Bacillus cereus* (Panosian et al., Acta Crystallogr., Sect. F: Struct. Biol. Cryst. Commun., 66:811-814 [2010]), *Bacillus sphaericus* (Horinouchi et al., New Biotechnol. 26:75-82 [2009]), and *Saccharomyces cerevisiae* (Walther et al., FEBS Lett. 586:4114-4118 [2012]), among others. The crystal structure of PPM from *Bacillus cereus* has been determined (Panosian et al., Acta Crystallogr., Sect. F: Struct. Biol. Cryst. Commun., 66:811-814 [2010], Panosian et al., J. Biol. Chem. 286:8043-8054 [2011]). PPMs catalyze the interconversion of the phosphate group on (deoxy)ribose from the 1-position to the 5-position with the equilibrium favorable position being on the (deoxy)ribose-5-phosphate side. Descriptions of the use of PPMs on non-natural ribose phosphate analogs is limited in the literature. One example is the isomerization of dideoxyribose 5-phosphate with *Bacillus stearothermophilus* PPM. In this report, the enzyme was active on this compound, but the activity was only 12%, as compared to ribose 5-phosphate (Hamamoto et al., Biosci. Biotechnol., Biochem. 62:1103-1108 [1998]). The poor activity of wild-type PPMs on non-natural substrates limits their use for the production of non-natural nucleosides, such as compound (1).

Due to the poor activity of PPMs on non-natural substrates for making non-natural and therapeutically useful nucleosides, there is a need for engineered PPMs that have improved activity and can operate under typical industrial conditions. The present invention addresses this need and provides engineered PPMs that are suitable for use in these reactions under industrial conditions.

Engineered PPM Polypeptides

The present invention provides engineered PPM polypeptides, polynucleotides encoding the polypeptides, methods of preparing the polypeptides, and methods for using the polypeptides. Where the description relates to polypeptides, it is to be understood that it also describes the polynucleotides encoding the polypeptides. In some embodiments, the present invention provides engineered, non-naturally occurring PPM enzymes with improved properties as compared to wild-type PPM enzymes. Any suitable reaction conditions find use in the present invention. In some embodiments, methods are used to analyze the improved properties of the engineered polypeptides to carry out the isomerization reaction. In some embodiments, the reaction conditions are modified with regard to concentrations or amounts of engineered PPM, substrate(s), buffer(s), solvent(s), pH, conditions including temperature and reaction time, and/or conditions with the engineered PPM polypeptide immobilized on a solid support, as further described below and in the Examples.

In some embodiments, additional reaction components or additional techniques are utilized to supplement the reaction conditions. In some embodiments, these include taking measures to stabilize or prevent inactivation of the enzyme, reduce product inhibition, shift reaction equilibrium to desired product formation.

In some further embodiments, any of the above described process for the conversion of substrate compound to product compound can further comprise one or more steps selected from: extraction, isolation, purification, crystallization, filtration, and/or lyophilization of product compound(s). Methods, techniques, and protocols for extracting, isolating, purifying, and/or crystallizing the product(s) from biocatalytic reaction mixtures produced by the processes provided herein are known to the ordinary artisan and/or accessed through routine experimentation. Additionally, illustrative methods are provided in the Examples below.

Methods of Using the Engineered Phosphopentomutase Enzymes

In some embodiments, the PPM enzymes described herein find use in processes for converting compound (4) to compound (3). In some embodiments, the process for performing the reversible isomerization reaction comprises a tandem 4-enzyme cascade setup involving DERA/PPM/PNP/SP enzymes. In some embodiments of the process, the reversible isomerization reaction is performed using only the PPM enzyme.

In the embodiments provided herein and illustrated in the Examples, various ranges of suitable reaction conditions that can be used in the processes, include but are not limited to, substrate loading, co-substrate loading, reductant, divalent transition metal, pH, temperature, buffer, solvent system, polypeptide loading, and reaction time. Further suitable reaction conditions for carrying out the process for biocatalytic conversion of substrate compounds to product compounds using an engineered PPM polypeptide described herein can be readily optimized in view of the guidance provided herein by routine experimentation that includes, but is not limited to, contacting the engineered PPM polypeptide and substrate compound under experimental reaction conditions of concentration, pH, temperature, and solvent conditions, and detecting the product compound.

Substrate compound in the reaction mixtures can be varied, taking into consideration, for example, the desired amount of product compound, the effect of substrate concentration on enzyme activity, stability of enzyme under reaction conditions, and the percent conversion of substrate to product. In some embodiments, the suitable reaction conditions comprise a substrate compound loading of at least about 0.5 to about 200 g/L, 1 to about 200 g/L, 5 to about 150 g/L, about 10 to about 100 g/L, 20 to about 100 g/L or about 50 to about 100 g/L. In some embodiments, the suitable reaction conditions comprise a substrate compound loading of at least about 0.5 g/L, at least about 1 g/L, at least about 5 g/L, at least about 10 g/L, at least about 15 g/L, at least about 20 g/L, at least about 30 g/L, at least about 50 g/L, at least about 75 g/L, at least about 100 g/L, at least about 150 g/L or at least about 200 g/L, or even greater. The values for substrate loadings provided herein are based on the molecular weight of compound (4); however, it also contemplated that the equivalent molar amounts of various deoxyribose-5-phosphate analogs also can be used in the process.

In carrying out the PPM mediated processes described herein, the engineered polypeptide may be added to the reaction mixture in the form of a purified enzyme, partially purified enzyme, whole cells transformed with gene(s) encoding the enzyme, as cell extracts and/or lysates of such cells, and/or as an enzyme immobilized on a solid support. Whole cells transformed with gene(s) encoding the engineered PPM enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (ammonium sulfate, polyethyleneimine, heat treatment or the like, followed by a desalting procedure prior to lyophilization (e.g., ultrafiltration, dialysis, etc.). Any of the enzyme preparations (including whole cell preparations) may be stabilized by crosslinking using known crosslinking agents, such as, for example, glutaraldehyde or immobilization to a solid phase (e.g., Eupergit C, and the like).

The gene(s) encoding the engineered PPM polypeptides can be transformed into host cells separately or together into the same host cell. For example, in some embodiments one set of host cells can be transformed with gene(s) encoding one engineered PPM polypeptide and another set can be transformed with gene(s) encoding another engineered PPM polypeptide. Both sets of transformed cells can be utilized together in the reaction mixture in the form of whole cells, or in the form of lysates or extracts derived therefrom. In other embodiments, a host cell can be transformed with gene(s) encoding multiple engineered PPM polypeptides. In some embodiments the engineered polypeptides can be expressed in the form of secreted polypeptides, and the culture medium containing the secreted polypeptides can be used for the PPM reaction.

In some embodiments, the improved activity and/or selectivity of the engineered PPM polypeptides disclosed herein provides for processes wherein higher percentage conversion can be achieved with lower concentrations of the engineered polypeptide. In some embodiments of the process, the suitable reaction conditions comprise an engineered polypeptide amount of about 0.03% (w/w), 0.05% (w/w), 0.1% (w/w), 0.15% (w/w), 0.2% (w/w), 0.3% (w/w), 0.4% (w/w), 0.5% (w/w), 1% (w/w), 2% (w/w), 5% (w/w), 10% (w/w), 20% (w/w) or more of substrate compound loading.

In some embodiments, the engineered polypeptide is present at about 0.01 g/L to about 15 g/L; about 0.05 g/L to about 15 g/L; about 0.1 g/L to about 10 g/L; about 1 g/L to about 8 g/L; about 0.5 g/L to about 10 g/L; about 1 g/L to about 10 g/L; about 0.1 g/L to about 5 g/L; about 0.5 g/L to about 5 g/L; or about 0.1 g/L to about 2 g/L. In some embodiments, the PPM polypeptide is present at about 0.01 g/L, 0.05 g/L, 0.1 g/L, 0.2 g/L, 0.5 g/L, 1 g/L, 2 g/L, 5 g/L, 10 g/L, or 15 g/L.

In some embodiments, the reaction conditions also comprise a divalent metal capable of serving as a cofactor in the reaction. Generally, the divalent metal co-factor is manganese (i.e., Mn+2). The manganese ion may be provided in various forms, such as manganese chloride ($MnCl_2$). While manganese ion functions efficiently in the engineered enzymes, it is to be understood that other divalent metals capable of acting as a co-factor can be used in the processes. In some embodiments, the reaction conditions can comprises a divalent metal cofactor, particularly Mn+2, at a concentration of about 1 mM to 1 M, 1 mM to 100 mM, 1 mM to about 50 mM, 25 mM to about 35 mM, about 30 mM to about 60 mM or about 55 mM to about 65 mM. In some embodiments, the reaction conditions comprise a divalent metal co-factor concentration of about 1 mM, 10 mM, 20 mM, 30 mM, 40 mM, 50 mM, 60 mM, 70 mM, 80 mM, 90 mM, or 100 mM.

During the course of the reaction, the pH of the reaction mixture may change. The pH of the reaction mixture may be maintained at a desired pH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, phosphate, 2-(N-morpholino)ethanesulfonic acid (MES), 3-(N-morpholino)propanesulfonic acid (MOPS), acetate, triethanolamine (TEoA), and 2-amino-2-hydroxymethyl-propane-1,3-diol (Tris), and the like. In some embodiments, the buffer is TEoA. In some embodiments of the process, the suitable reaction conditions comprise a buffer (e.g., TEoA) concentration of from about 0.01 to about 0.4 M, 0.05 to about 0.4 M, 0.1 to about 0.3 M, or about 0.1 to about 0.2 M. In some embodiments, the reaction condition comprises a buffer (e.g., TEoA) concentration of about 0.01, 0.02, 0.03, 0.04, 0.05, 0.07, 0.1, 0.12, 0.14, 0.16, 0.18, 0.2, 0.3, or 0.4 M.

In some embodiments, the reaction condition comprises a wet organic solvent. Suitable wet organic solvents are known in the art and include, by way of example and not limitation, wet isopropyl alcohol, wet toluene, and wet methyl tertiary butyl ether.

In the embodiments of the process, the reaction conditions can comprise a suitable pH. The desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH from about 4 to about 10, pH from about 5 to about 10, pH from about 5 to about 9, pH from about 6 to about 9, pH from about 6 to about 8. In some embodiments, the reaction conditions comprise a solution pH of about 4, 4.5, 5, 5.5, 6, 6.5, 7, 7.5, 8, 8.5, 9, 9.5, or 10.

In the embodiments of the processes herein, a suitable temperature can be used for the reaction conditions, for example, taking into consideration the increase in reaction rate at higher temperatures, and the activity of the enzyme during the reaction time period. Accordingly, in some embodiments, the suitable reaction conditions comprise a temperature of about 10° C. to about 60° C., about 10° C. to about 55° C., about 15° C. to about 60° C., about 20° C. to about 60° C., about 20° C. to about 55° C., about 25° C. to about 55° C., or about 30° C. to about 50° C. In some embodiments, the suitable reaction conditions comprise a temperature of about 10° C., 15° C., 20° C., 25° C., 30° C., 35° C., 40° C., 45° C., 50° C., 55° C., or 60° C. In some embodiments, the temperature during the enzymatic reaction can be maintained at a specific temperature throughout the course of the reaction. In some embodiments, the temperature during the enzymatic reaction can be adjusted over a temperature profile during the course of the reaction.

In some embodiments, the reaction conditions can comprise a surfactant for stabilizing or enhancing the reaction. Surfactants can comprise non-ionic, cationic, anionic and/or amphiphilic surfactants. Exemplary surfactants, include by way of example and not limitation, nonyl phenoxypolyethoxylethanol (NP40), Triton X-100, polyoxyethylene-stearylamine, cetyltrimethylammonium bromide, sodium oleylamidosulfate, polyoxyethylene-sorbitanmonostearate, hexadecyldimethylamine, etc. Any surfactant that may stabilize or enhance the reaction may be employed. The concentration of the surfactant to be employed in the reaction may be generally from 0.1 to 50 mg/ml, particularly from 1 to 20 mg/ml.

In some embodiments, the reaction conditions can include an antifoam agent, which aids in reducing or preventing formation of foam in the reaction solution, such as when the reaction solutions are mixed or sparged. Anti-foam agents include non-polar oils (e.g., minerals, silicones, etc.), polar oils (e.g., fatty acids, alkyl amines, alkyl amides, alkyl sulfates, etc.), and hydrophobic (e.g., treated silica, polypropylene, etc.), some of which also function as surfactants. Exemplary anti-foam agents include, Y-30® (Dow Corning), poly-glycol copolymers, oxy/ethoxylated alcohols, and polydimethylsiloxanes. In some embodiments, the anti-foam can be present at about 0.001% (v/v) to about 5% (v/v), about 0.01% (v/v) to about 5% (v/v), about 0.1% (v/v) to about 5% (v/v), or about 0.1% (v/v) to about 2% (v/v). In some embodiments, the anti-foam agent can be present at about 0.001% (v/v), about 0.01% (v/v), about 0.1% (v/v), about 0.5% (v/v), about 1% (v/v), about 2% (v/v), about 3% (v/v), about 4% (v/v), or about 5% (v/v) or more as desirable to promote the reaction.

The quantities of reactants used in the isomerization reaction will generally vary depending on the quantities of product desired, and concomitantly the amount of substrate employed. Those having ordinary skill in the art will readily understand how to vary these quantities to tailor them to the desired level of productivity and scale of production.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor, co-substrate, PPM enzyme, other enzymes (e.g. SP, DERA, and PNP) and substrate may be added first to the solvent.

The solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

For improved mixing efficiency when an aqueous co-solvent system is used, the PPM enzyme, and cofactor may be added and mixed into the aqueous phase first. The organic phase may then be added and mixed in, followed by addition of the PPM enzyme substrate, other enzymes (e.g. SP, DERA, and PNP), and co-substrate. Alternatively, the PPM enzyme substrate may be premixed in the organic phase, prior to addition to the aqueous phase.

The isomerization process is generally allowed to proceed until further conversion of substrate to product does not change significantly with reaction time (e.g., less than 10% of substrate being converted, or less than 5% of substrate being converted). In some embodiments, the reaction is allowed to proceed until there is complete or near complete conversion of substrate to product. Transformation of substrate to product can be monitored using known methods by detecting substrate and/or product, with or without derivatization. Suitable analytical methods include gas chromatography, HPLC, MS, and the like.

In some embodiments of the process, the suitable reaction conditions comprise a substrate loading of at least about 5 g/L, 10 g/L, 20 g/L, 30 g/L, 40 g/L, 50 g/L, 60 g/L, 70 g/L, 100 g/L, or more, and wherein the method results in at least about 50%, 60%, 70%, 80%, 90%, 95% or greater conversion of substrate compound to product compound in about 48 h or less, in about 36 h or less, in about 24 h or less, or in about 3 h or less.

In further embodiments of the processes for converting substrate compound to product compound using the engineered PPM polypeptides, the suitable reaction conditions can comprise an initial substrate loading to the reaction solution which is then contacted by the polypeptide. This reaction solution is then further supplemented with additional substrate compound as a continuous or batchwise addition over time at a rate of at least about 1 g/L/h, at least about 2 g/L/h, at least about 4 g/L/h, at least about 6 g/L/h, or higher. Thus, according to these suitable reaction conditions, polypeptide is added to a solution having an initial substrate loading of at least about 20 g/L, 30 g/L, or 40 g/L. This addition of polypeptide is then followed by continuous addition of further substrate to the solution at a rate of about 2 g/L/h, 4 g/L/h, or 6 g/L/h until a much higher final substrate loading of at least about 30 g/L, 40 g/L, 50 g/L, 60 g/L, 70 g/L, 100 g/L, 150 g/L, 200 g/L or more, is reached. Accordingly, in some embodiments of the process, the suitable reaction conditions comprise addition of the polypeptide to a solution having an initial substrate loading of at least about 20 g/L, 30 g/L, or 40 g/L followed by addition of further substrate to the solution at a rate of about 2 g/L/h, 4 g/L/h, or 6 g/L/h until a final substrate loading of at least about 30 g/L, 40 g/L, 50 g/L, 60 g/L, 70 g/L, 100 g/L or more, is reached. This substrate supplementation reaction condition allows for higher substrate loadings to be achieved while maintaining high rates of conversion of substrate to product of at least about 50%, 60%, 70%, 80%, 90% or greater conversion of substrate.

In some embodiments of the process, reactions are performed in a tandem 4-enzyme cascade setup involving DERA/PPM/PNP/SP enzymes.

In some embodiments, additional reaction components or additional techniques are carried out to supplement the reaction conditions. These can include taking measures to stabilize or prevent inactivation of the enzyme, reduce product inhibition, shift reaction equilibrium to product formation.

In further embodiments, any of the above described process for the conversion of substrate compound to product compound can further comprise one or more steps selected from: extraction; isolation; purification; and crystallization of product compound. Methods, techniques, and protocols for extracting, isolating, purifying, and/or crystallizing the product from biocatalytic reaction mixtures produced by the above disclosed processes are known to the ordinary artisan and/or accessed through routine experimentation. Additionally, illustrative methods are provided in the Examples below.

Various features and embodiments of the invention are illustrated in the following representative examples, which are intended to be illustrative, and not limiting.

Engineered PPM Polynucleotides Encoding Engineered Polypeptides, Expression Vectors and Host Cells The present invention provides polynucleotides encoding the engineered enzyme polypeptides described herein. In some embodiments, the polynucleotides are operatively linked to one or more heterologous regulatory sequences that control gene expression to create a recombinant polynucleotide capable of expressing the polypeptide. In some embodiments, expression constructs containing at least one heterologous polynucleotide encoding the engineered enzyme polypeptide(s) is introduced into appropriate host cells to express the corresponding enzyme polypeptide(s).

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode an engineered enzyme (e.g., PPM) polypeptide. Thus, the present invention provides methods and compositions for the production of each and every possible variation of enzyme polynucleotides that could be made that encode the enzyme polypeptides described herein by selecting combinations based on the possible codon choices, and all such variations are to be considered specifically disclosed for any polypeptide described herein, including the amino acid sequences presented in the Examples (e.g., in the various Tables).

In some embodiments, the codons are preferably optimized for utilization by the chosen host cell for protein production. For example, preferred codons used in bacteria are typically used for expression in bacteria. Consequently, codon optimized polynucleotides encoding the engineered enzyme polypeptides contain preferred codons at about 40%, 50%, 60%, 70%, 80%, 90%, or greater than 90% of the codon positions in the full length coding region.

In some embodiments, the enzyme polynucleotide encodes an engineered polypeptide having enzyme activity with the properties disclosed herein, wherein the polypeptide comprises an amino acid sequence having at least 60%, 65%, 70%, 75%, 80%, 85%, 86%, 87%, 88%, 89%, 90%, 91%, 92%, 93%, 94%, 95%, 96%, 97%, 98%, 99% or more identity to a reference sequence selected from the SEQ ID NOS provided herein, or the amino acid sequence of any variant (e.g., those provided in the Examples), and one or more residue differences as compared to the reference polynucleotide(s), or the amino acid sequence of any variant as disclosed in the Examples (for example 1, 2, 3, 4, 5, 6, 7, 8, 9, 10 or more amino acid residue positions). In some embodiments, the reference polypeptide sequence is selected from SEQ ID NOS: 4, 12, 16, 90, 198, 352, 412 and/or 418.

In some embodiments, the polynucleotides are capable of hybridizing under highly stringent conditions to a reference polynucleotide sequence selected from any polynucleotide sequence provided herein, or a complement thereof, or a polynucleotide sequence encoding any of the variant enzyme polypeptides provided herein. In some embodiments, the polynucleotide capable of hybridizing under highly stringent conditions encodes an enzyme polypeptide comprising an amino acid sequence that has one or more residue differences as compared to a reference sequence.

In some embodiments, an isolated polynucleotide encoding any of the engineered enzyme polypeptides herein is manipulated in a variety of ways to facilitate expression of the enzyme polypeptide. In some embodiments, the polynucleotides encoding the enzyme polypeptides comprise expression vectors where one or more control sequences is present to regulate the expression of the enzyme polynucleotides and/or polypeptides Manipulation of the isolated polynucleotide prior to its insertion into a vector may be desirable or necessary depending on the expression vector utilized. Techniques for modifying polynucleotides and nucleic acid sequences utilizing recombinant DNA methods are well known in the art. In some embodiments, the control sequences include among others, promoters, leader sequences, polyadenylation sequences, propeptide sequences, signal peptide sequences, and transcription terminators. In some embodiments, suitable promoters are selected based on the host cells selection. For bacterial host cells, suitable promoters for directing transcription of the nucleic acid constructs of the present disclosure, include, but are not limited to promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl Acad. Sci. USA 75: 3727-3731 [1978]), as well as the tac promoter (See e.g., DeBoer et al., Proc. Natl Acad. Sci. USA 80: 21-25 [1983]). Exemplary promoters for filamentous fungal host cells, include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae*

3-phosphoglycerate kinase. Other useful promoters for yeast host cells are known in the art (See e.g., Romanos et al., Yeast 8:423-488 [1992]).

In some embodiments, the control sequence is also a suitable transcription terminator sequence (i.e., a sequence recognized by a host cell to terminate transcription). In some embodiments, the terminator sequence is operably linked to the 3' terminus of the nucleic acid sequence encoding the enzyme polypeptide. Any suitable terminator which is functional in the host cell of choice finds use in the present invention. Exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are known in the art (See e.g., Romanos et al., supra).

In some embodiments, the control sequence is also a suitable leader sequence (i.e., a non-translated region of an mRNA that is important for translation by the host cell). In some embodiments, the leader sequence is operably linked to the 5' terminus of the nucleic acid sequence encoding the enzyme polypeptide. Any suitable leader sequence that is functional in the host cell of choice find use in the present invention. Exemplary leaders for filamentous fungal host cells are obtained from the genes for *Aspergillus oryzae* TAKA amylase, and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the control sequence is also a polyadenylation sequence (i.e., a sequence operably linked to the 3' terminus of the nucleic acid sequence and which, when transcribed, is recognized by the host cell as a signal to add polyadenosine residues to transcribed mRNA). Any suitable polyadenylation sequence which is functional in the host cell of choice finds use in the present invention. Exemplary polyadenylation sequences for filamentous fungal host cells include, but are not limited to the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known (See e.g., Guo and Sherman, Mol. Cell. Bio., 15:5983-5990 [1995]).

In some embodiments, the control sequence is also a signal peptide (i.e., a coding region that codes for an amino acid sequence linked to the amino terminus of a polypeptide and directs the encoded polypeptide into the cell's secretory pathway). In some embodiments, the 5' end of the coding sequence of the nucleic acid sequence inherently contains a signal peptide coding region naturally linked in translation reading frame with the segment of the coding region that encodes the secreted polypeptide. Alternatively, in some embodiments, the 5' end of the coding sequence contains a signal peptide coding region that is foreign to the coding sequence. Any suitable signal peptide coding region which directs the expressed polypeptide into the secretory pathway of a host cell of choice finds use for expression of the engineered polypeptide(s). Effective signal peptide coding regions for bacterial host cells are the signal peptide coding regions include, but are not limited to those obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57:109-137 [1993]). In some embodiments, effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells include, but are not limited to those from the genes for *Saccharomyces cerevisiae* alpha-factor and *Saccharomyces cerevisiae* invertase.

In some embodiments, the control sequence is also a propeptide coding region that codes for an amino acid sequence positioned at the amino terminus of a polypeptide. The resultant polypeptide is referred to as a "proenzyme," "propolypeptide," or "zymogen." A propolypeptide can be converted to a mature active polypeptide by catalytic or autocatalytic cleavage of the propeptide from the propolypeptide. The propeptide coding region may be obtained from any suitable source, including, but not limited to the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also utilized. These sequences facilitate the regulation of the expression of the polypeptide relative to the growth of the host cell. Examples of regulatory systems are those that cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, but are not limited to the ADH2 system or GALL system. In filamentous fungi, suitable regulatory sequences include, but are not limited to the TAKA alpha-amylase promoter, *Aspergillus niger* glucoamylase promoter, and *Aspergillus oryzae* glucoamylase promoter.

In another aspect, the present invention is directed to a recombinant expression vector comprising a polynucleotide encoding an engineered enzyme polypeptide, and one or more expression regulating regions such as a promoter and a terminator, a replication origin, etc., depending on the type of hosts into which they are to be introduced. In some embodiments, the various nucleic acid and control sequences described herein are joined together to produce recombinant expression vectors which include one or more convenient restriction sites to allow for insertion or substitution of the nucleic acid sequence encoding the enzyme polypeptide at such sites. Alternatively, in some embodiments, the nucleic acid sequence of the present invention is expressed by inserting the nucleic acid sequence or a nucleic acid construct comprising the sequence into an appropriate vector for expression. In some embodiments involving the creation of the expression vector, the coding sequence is located in the vector so that the coding sequence is operably linked with the appropriate control sequences for expression.

The recombinant expression vector may be any suitable vector (e.g., a plasmid or virus), that can be conveniently subjected to recombinant DNA procedures and bring about the expression of the enzyme polynucleotide sequence. The choice of the vector typically depends on the compatibility of the vector with the host cell into which the vector is to be introduced. The vectors may be linear or closed circular plasmids.

In some embodiments, the expression vector is an autonomously replicating vector (i.e., a vector that exists as an extra-chromosomal entity, the replication of which is independent of chromosomal replication, such as a plasmid, an extra-chromosomal element, a minichromosome, or an artificial chromosome). The vector may contain any means for assuring self-replication. In some alternative embodiments, the vector is one in which, when introduced into the host cell, it is integrated into the genome and replicated together with the chromosome(s) into which it has been integrated. Furthermore, in some embodiments, a single vector or plasmid, or two or more vectors or plasmids which together contain the total DNA to be introduced into the genome of the host cell, and/or a transposon is utilized.

In some embodiments, the expression vector contains one or more selectable markers, which permit easy selection of transformed cells. A "selectable marker" is a gene, the product of which provides for biocide or viral resistance, resistance to heavy metals, prototrophy to auxotrophs, and the like. Examples of bacterial selectable markers include, but are not limited to the dal genes from *Bacillus subtilis* or *Bacillus licheniformis*, or markers, which confer antibiotic resistance such as ampicillin, kanamycin, chloramphenicol or tetracycline resistance. Suitable markers for yeast host cells include, but are not limited to ADE2, HIS3, LEU2, LYS2, MET3, TRP1, and URA3. Selectable markers for use in filamentous fungal host cells include, but are not limited to, amdS (acetamidase; e.g., from *A. nidulans* or *A. orzyae*), argB (ornithine carbamoyltransferases), bar (phosphinothricin acetyltransferase; e.g., from *S. hygroscopicus*), hph (hygromycin phosphotransferase), niaD (nitrate reductase), pyrG (orotidine-5'-phosphate decarboxylase; e.g., from *A. nidulans* or *A. orzyae*), sC (sulfate adenyltransferase), and trpC (anthranilate synthase), as well as equivalents thereof.

In another aspect, the present invention provides a host cell comprising at least one polynucleotide encoding at least one engineered enzyme polypeptide of the present invention, the polynucleotide(s) being operatively linked to one or more control sequences for expression of the engineered enzyme enzyme(s) in the host cell. Host cells suitable for use in expressing the polypeptides encoded by the expression vectors of the present invention are well known in the art and include but are not limited to, bacterial cells, such as *E. coli, Vibrio fluvialis, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells also include various *Escherichia coli* strains (e.g., W3110 (ΔfhuA) and BL21). Examples of bacterial selectable markers include, but are not limited to the dal genes from *Bacillus subtilis* or *Bacillus licheniformis*, or markers, which confer antibiotic resistance such as ampicillin, kanamycin, chloramphenicol, and or tetracycline resistance.

In some embodiments, the expression vectors of the present invention contain an element(s) that permits integration of the vector into the host cell's genome or autonomous replication of the vector in the cell independent of the genome. In some embodiments involving integration into the host cell genome, the vectors rely on the nucleic acid sequence encoding the polypeptide or any other element of the vector for integration of the vector into the genome by homologous or nonhomologous recombination.

In some alternative embodiments, the expression vectors contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements preferably contain a sufficient number of nucleotides, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A ori or the origins of replication of plasmids pBR322, pUC19, pACYC177 (which plasmid has the P15A ori), or pACYC184 permitting replication in *E. coli*, and pUB110, pE194, or pTA1060 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it's functioning temperature-sensitive in the host cell (See e.g., Ehrlich, Proc. Natl. Acad. Sci. USA 75:1433 [1978]).

In some embodiments, more than one copy of a nucleic acid sequence of the present invention is inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many of the expression vectors for use in the present invention are commercially available. Suitable commercial expression vectors include, but are not limited to the p3xFLAGTM™ expression vectors (Sigma-Aldrich Chemicals), which include a CMV promoter and hGH polyadenylation site for expression in mammalian host cells and a pBR322 origin of replication and ampicillin resistance markers for amplification in *E. coli*. Other suitable expression vectors include, but are not limited to pBluescriptII SK(−) and pBK-CMV (Stratagene), and plasmids derived from pBR322 (Gibco BRL), pUC (Gibco BRL), pREP4, pCEP4 (Invitrogen) or pPoly (See e.g., Lathe et al., Gene 57:193-201 [1987]).

Thus, in some embodiments, a vector comprising a sequence encoding at least one variant phosphopentomutase is transformed into a host cell in order to allow propagation of the vector and expression of the variant phosphopentomutase(s). In some embodiments, the variant phosphopentomutases are post-translationally modified to remove the signal peptide and in some cases may be cleaved after secretion. In some embodiments, the transformed host cell described above is cultured in a suitable nutrient medium under conditions permitting the expression of the variant phosphopentomutase(s). Any suitable medium useful for culturing the host cells finds use in the present invention, including, but not limited to minimal or complex media containing appropriate supplements. In some embodiments, host cells are grown in HTP media. Suitable media are available from various commercial suppliers or may be prepared according to published recipes (e.g., in catalogues of the American Type Culture Collection).

In another aspect, the present invention provides host cells comprising a polynucleotide encoding an improved phosphopentomutase polypeptide provided herein, the polynucleotide being operatively linked to one or more control sequences for expression of the phosphopentomutase enzyme in the host cell. Host cells for use in expressing the phosphopentomutase polypeptides encoded by the expression vectors of the present invention are well known in the art and include but are not limited to, bacterial cells, such as *E. coli, Bacillus megaterium, Lactobacillus kefir, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Appropriate culture media and growth conditions for the above-described host cells are well known in the art.

Polynucleotides for expression of the phosphopentomutase may be introduced into cells by various methods known in the art. Techniques include among others, electroporation, biolistic particle bombardment, liposome mediated transfection, calcium chloride transfection, and protoplast fusion. Various methods for introducing polynucleotides into cells are known to those skilled in the art.

In some embodiments, the host cell is a eukaryotic cell. Suitable eukaryotic host cells include, but are not limited to, fungal cells, algal cells, insect cells, and plant cells. Suitable fungal host cells include, but are not limited to, Ascomycota, Basidiomycota, Deuteromycota, Zygomycota, Fungi *imperfecti*. In some embodiments, the fungal host cells are yeast cells and filamentous fungal cells. The filamentous fungal host cells of the present invention include all filamentous forms of the subdivision Eumycotina and Oomycota. Filamentous fungi are characterized by a vegetative mycelium with a cell wall composed of chitin, cellulose and other complex polysaccharides. The filamentous fungal host cells of the present invention are morphologically distinct from yeast.

In some embodiments of the present invention, the filamentous fungal host cells are of any suitable genus and species, including, but not limited to *Achlya, Acremonium, Aspergillus, Aureobasidium, Bjerkandera, Ceriporiopsis, Cephalosporium, Chrysosporium, Cochliobolus, Corynascus, Cryphonectria, Cryptococcus, Coprinus, Coriolus, Diplodia, Endothis, Fusarium, Gibberella, Gliocladium, Humicola, Hypocrea, Myceliophthora, Mucor, Neurospora, Penicillium, Podospora, Phlebia, Piromyces, Pyricularia, Rhizomucor, Rhizopus, Schizophyllum, Scytalidium, Sporotrichum, Talaromyces, Thermoascus, Thielavia, Trametes, Tolypocladium, Trichoderma, Verticillium*, and/or *Volvariella*, and/or teleomorphs, or anamorphs, and synonyms, basionyms, or taxonomic equivalents thereof.

In some embodiments of the present invention, the host cell is a yeast cell, including but not limited to cells of *Candida, Hansenula, Saccharomyces, Schizosaccharomyces, Pichia, Kluyveromyces*, or *Yarrowia* species. In some embodiments of the present invention, the yeast cell is *Hansenula polymorpha, Saccharomyces cerevisiae, Saccharomyces carlsbergensis, Saccharomyces diastaticus, Saccharomyces norbensis, Saccharomyces kluyveri, Schizosaccharomyces pombe, Pichia pastoris, Pichia finlandica, Pichia trehalophila, Pichia kodamae, Pichia membranaefaciens, Pichia opuntiae, Pichia thermotolerans, Pichia salictaria, Pichia quercuum, Pichia pyperi, Pichia stipitis, Pichia methanolica, Pichia angusta, Kluyveromyces lactis, Candida albicans*, or *Yarrowia* hpolytica.

In some embodiments of the invention, the host cell is an algal cell such as *Chlamydomonas* (e.g., *C. reinhardtii*) and *Phormidium* (P. sp. ATCC29409).

In some other embodiments, the host cell is a prokaryotic cell. Suitable prokaryotic cells include, but are not limited to Gram-positive, Gram-negative and Gram-variable bacterial cells. Any suitable bacterial organism finds use in the present invention, including but not limited to *Agrobacterium, Alicyclobacillus, Anabaena, Anacystis, Acinetobacter, Acidothermus, Arthrobacter, Azobacter, Bacillus, Bifidobacterium, Brevibacterium, Butyrivibrio, Buchnera, Campestris, Camplyobacter, Clostridium, Corynebacterium, Chromatium, Coprococcus, Escherichia, Enterococcus, Enterobacter, Erwinia, Fusobacterium, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburia, Rhodospirillum, Rhodococcus, Scenedesmus, Streptomyces, Streptococcus*, Synecoccus, *Saccharomonospora, Staphylococcus, Serratia, Salmonella, Shigella, Thermoanaerobacterium, Tropheryma, Tularensis, Temecula, Thermosynechococcus, Thermococcus, Ureaplasma, Xanthomonas, Xylella, Yersinia* and *Zymomonas*. In some embodiments, the host cell is a species of *Agrobacterium, Acinetobacter, Azobacter, Bacillus, Bifidobacterium, Buchnera, Geobacillus, Campylobacter, Clostridium, Corynebacterium, Escherichia, Enterococcus, Erwinia, Flavobacterium, Lactobacillus, Lactococcus, Pantoea, Pseudomonas, Staphylococcus, Salmonella, Streptococcus, Streptomyces*, or *Zymomonas*. In some embodiments, the bacterial host strain is non-pathogenic to humans. In some embodiments the bacterial host strain is an industrial strain. Numerous bacterial industrial strains are known and suitable in the present invention. In some embodiments of the present invention, the bacterial host cell is an *Agrobacterium* species (e.g., *A. radiobacter, A. rhizogenes*, and *A. rubi*). In some embodiments of the present invention, the bacterial host cell is an *Arthrobacter* species (e.g., *A. aurescens, A. citreus, A. globiformis, A. hydrocarboglutamicus, A. mysorens, A. nicotianae*, A. paraffineus, A. protophonniae, A. roseoparqffinus, *A. sulfureus*, and *A. ureafaciens*). In some embodiments of the present invention, the bacterial host cell is a *Bacillus* species (e.g., *B. thuringensis, B. anthracia, B. megaterium,*

*B. subtilis, B. lentus, B. circulans, B. pumilus, B. lautus, B. coagulans, B. brevis, B. firmus, B. alkaophius, B. licheniformis, B. clausii, B. stearothermophilus, B. halodurans*, and *B. amyloliquefaciens*). In some embodiments, the host cell is an industrial *Bacillus* strain including but not limited to *B. subtilis, B. pumilus, B. licheniformis, B. megaterium, B. clausii, B. stearothermophilus*, or *B. amyloliquefaciens*. In some embodiments, the *Bacillus* host cells are *B. subtilis, B. licheniformis, B. megaterium, B. stearothermophilus*, and/or *B. amyloliquefaciens*. In some embodiments, the bacterial host cell is a *Clostridium* species (e.g., *C. acetobutylicum, C. tetani* E88, *C. lituseburense, C. saccharobutylicum, C. perfringens*, and C. beyerinckii). In some embodiments, the bacterial host cell is a *Corynebacterium* species (e.g., *C. glutamicum* and *C. acetoacidophilum*). In some embodiments the bacterial host cell is an *Escherichia* species (e.g., *E. coli*). In some embodiments, the host cell is *Escherichia coli* W3110. In some embodiments, the bacterial host cell is an *Erwinia* species (e.g., *E. uredovora, E. carotovora, E. ananas, E. herbicola, E. punctata*, and *E. terreus*). In some embodiments, the bacterial host cell is a *Pantoea* species (e.g., *P. citrea*, and *P. agglomerans*). In some embodiments the bacterial host cell is a *Pseudomonas* species (e.g., *P. putida, P. aeruginosa*, P. mevalonii, and P. sp. D-01 10). In some embodiments, the bacterial host cell is a *Streptococcus* species (e.g., S. equisimiles, *S. pyogenes*, and *S. uberis*). In some embodiments, the bacterial host cell is a *Streptomyces* species (e.g., *S. ambofaciens, S. achromogenes, S. avermitilis, S. coelicolor, S. aureofaciens, S. aureus, S. fungicidicus, S. griseus*, and *S. lividans*). In some embodiments, the bacterial host cell is a *Zymomonas* species (e.g., *Z. mobilis*, and *Z. lipolytica*).

Many prokaryotic and eukaryotic strains that find use in the present invention are readily available to the public from a number of culture collections such as American Type Culture Collection (ATCC), Deutsche Sammlung von Mikroorganismen and Zellkulturen GmbH (DSM), Centraalbureau Voor Schimmelcultures (CBS), and Agricultural Research Service Patent Culture Collection, Northern Regional Research Center (NRRL).

In some embodiments, host cells are genetically modified to have characteristics that improve protein secretion, protein stability and/or other properties desirable for expression and/or secretion of a protein. Genetic modification can be achieved by genetic engineering techniques and/or classical microbiological techniques (e.g., chemical or UV mutagenesis and subsequent selection). Indeed, in some embodiments, combinations of recombinant modification and classical selection techniques are used to produce the host cells. Using recombinant technology, nucleic acid molecules can be introduced, deleted, inhibited or modified, in a manner that results in increased yields of phosphopentomutase variant(s) within the host cell and/or in the culture medium. For example, knockout of Alp 1 function results in a cell that is protease deficient, and knockout of pyr5 function results in a cell with a pyrimidine deficient phenotype. In one genetic engineering approach, homologous recombination is used to induce targeted gene modifications by specifically targeting a gene in vivo to suppress expression of the encoded protein. In alternative approaches, siRNA, antisense and/or ribozyme technology find use in inhibiting gene expression. A variety of methods are known in the art for reducing expression of protein in cells, including, but not limited to deletion of all or part of the gene encoding the protein and site-specific mutagenesis to disrupt expression or activity of the gene product. (See e.g., Chaveroche et al., Nucl. Acids Res., 28:22 e97 [2000]; Cho et al., Molec. Plant Microbe Interact., 19:7-15 [2006]; Maruyama and Kitamoto, Biotechnol Lett., 30:1811-1817 [2008]; Takahashi et al., Mol. Gen. Genom., 272: 344-352 [2004]; and You et al., Arch. Microbiol., 191:615-622 [2009], all of which are incorporated by reference herein). Random mutagenesis, followed by screening for desired mutations also finds use (See e.g., Combier et al., FEMS Microbiol. Lett., 220:141-8 [2003]; and Firon et al., Eukary. Cell 2:247-55 [2003], both of which are incorporated by reference).

Introduction of a vector or DNA construct into a host cell can be accomplished using any suitable method known in the art, including but not limited to calcium phosphate transfection, DEAE-dextran mediated transfection, PEG-mediated transformation, electroporation, or other common techniques known in the art. In some embodiments, the *Escherichia coli* expression vector pCK100900i (See, U.S. Pat. No. 9,714,437, which is hereby incorporated by reference) finds use.

In some embodiments, the engineered host cells (i.e., "recombinant host cells") of the present invention are cultured in conventional nutrient media modified as appropriate for activating promoters, selecting transformants, or amplifying the phosphopentomutase polynucleotide. Culture conditions, such as temperature, pH and the like, are those previously used with the host cell selected for expression, and are well-known to those skilled in the art. As noted, many standard references and texts are available for the culture and production of many cells, including cells of bacterial, plant, animal (especially mammalian) and archebacterial origin.

In some embodiments, cells expressing the variant phosphopentomutase polypeptides of the invention are grown under batch or continuous fermentations conditions. Classical "batch fermentation" is a closed system, wherein the compositions of the medium is set at the beginning of the fermentation and is not subject to artificial alternations during the fermentation. A variation of the batch system is a "fed-batch fermentation" which also finds use in the present invention. In this variation, the substrate is added in increments as the fermentation progresses. Fed-batch systems are useful when catabolite repression is likely to inhibit the metabolism of the cells and where it is desirable to have limited amounts of substrate in the medium. Batch and fed-batch fermentations are common and well known in the art. "Continuous fermentation" is an open system where a defined fermentation medium is added continuously to a bioreactor and an equal amount of conditioned medium is removed simultaneously for processing. Continuous fermentation generally maintains the cultures at a constant high density where cells are primarily in log phase growth. Continuous fermentation systems strive to maintain steady state growth conditions. Methods for modulating nutrients and growth factors for continuous fermentation processes as well as techniques for maximizing the rate of product formation are well known in the art of industrial microbiology.

In some embodiments of the present invention, cell-free transcription/translation systems find use in producing variant phosphopentomutase(s). Several systems are commercially available and the methods are well-known to those skilled in the art.

The present invention provides methods of making variant phosphopentomutase polypeptides or biologically active fragments thereof. In some embodiments, the method comprises: providing a host cell transformed with a polynucleotide encoding an amino acid sequence that comprises at least about 70% (or at least about 75%, at least about 80%, at least about 85%, at least about 90%, at least about 95%, at least about 96%, at least about 97%, at least about 98%, or at least about 99%) sequence identity to SEQ ID NO: 4, 12, 16, 90, 198, 352, 412 and/or 418, and comprising at least one mutation as provided herein; culturing the transformed host cell in a culture medium under conditions in which the host cell expresses the encoded variant phosphopentomutase polypeptide; and optionally recovering or isolating the expressed variant phosphopentomutase polypeptide, and/or recovering or isolating the culture medium containing the expressed variant phosphopentomutase polypeptide. In some embodiments, the methods further provide optionally lysing the transformed host cells after expressing the encoded phosphopentomutase polypeptide and optionally recovering and/or isolating the expressed variant phosphopentomutase polypeptide from the cell lysate. The present invention further provides methods of making a variant phosphopentomutase polypeptide comprising cultivating a host cell transformed with a variant phosphopentomutase polypeptide under conditions suitable for the production of the variant phosphopentomutase polypeptide and recovering the variant phosphopentomutase polypeptide. Typically, recovery or isolation of the phosphopentomutase polypeptide is from the host cell culture medium, the host cell or both, using protein recovery techniques that are well known in the art, including those described herein. In some embodiments, host cells are harvested by centrifugation, disrupted by physical or chemical means, and the resulting crude extract retained for further purification. Microbial cells employed in expression of proteins can be disrupted by any convenient method, including, but not limited to freeze-thaw cycling, sonication, mechanical disruption, and/or use of cell lysing agents, as well as many other suitable methods well known to those skilled in the art.

Engineered phosphopentomutase enzymes expressed in a host cell can be recovered from the cells and/or the culture medium using any one or more of the techniques known in the art for protein purification, including, among others, lysozyme treatment, sonication, filtration, salting-out, ultracentrifugation, and chromatography. Suitable solutions for lysing and the high efficiency extraction of proteins from bacteria, such as *E. coli*, are commercially available under the trade name CelLytic B™ (Sigma-Aldrich). Thus, in some embodiments, the resulting polypeptide is recovered/isolated and optionally purified by any of a number of methods known in the art. For example, in some embodiments, the polypeptide is isolated from the nutrient medium by conventional procedures including, but not limited to, centrifugation, filtration, extraction, spray-drying, evaporation, chromatography (e.g., ion exchange, affinity, hydrophobic interaction, chromatofocusing, and size exclusion), or precipitation. In some embodiments, protein refolding steps are used, as desired, in completing the configuration of the mature protein. In addition, in some embodiments, high performance liquid chromatography (HPLC) is employed in the final purification steps. For example, in some embodiments, methods known in the art, find use in the present invention (See e.g., Parry et al., Biochem. J., 353:117 [2001]; and Hong et al., Appl. Microbiol. Biotechnol., 73:1331 [2007], both of which are incorporated herein by reference). Indeed, any suitable purification methods known in the art find use in the present invention.

Chromatographic techniques for isolation of the phosphopentomutase polypeptide include, but are not limited to reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., are known to those skilled in the art.

In some embodiments, affinity techniques find use in isolating the improved phosphopentomutase enzymes. For affinity chromatography purification, any antibody which specifically binds the phosphopentomutase polypeptide may be used. For the production of antibodies, various host animals, including but not limited to rabbits, mice, rats, etc., may be immunized by injection with the phosphopentomutase. The phosphopentomutase polypeptide may be attached to a suitable carrier, such as BSA, by means of a side chain functional group or linkers attached to a side chain functional group. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (*Bacillus* Calmette *Guerin*) and *Corynebacterium parvum.*

In some embodiments, the phosphopentomutase variants are prepared and used in the form of cells expressing the enzymes, as crude extracts, or as isolated or purified preparations. In some embodiments, the phosphopentomutase variants are prepared as lyophilisates, in powder form (e.g., acetone powders), or prepared as enzyme solutions. In some embodiments, the phosphopentomutase variants are in the form of substantially pure preparations.

In some embodiments, the phosphopentomutase polypeptides are attached to any suitable solid substrate. Solid substrates include but are not limited to a solid phase, surface, and/or membrane. Solid supports include, but are not limited to organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of the substrate can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location. A plurality of supports can be configured on an array at various locations, addressable for robotic delivery of reagents, or by detection methods and/or instruments.

In some embodiments, immunological methods are used to purify phosphopentomutase variants. In one approach, antibody raised against a wild-type or variant phosphopentomutase polypeptide (e.g., against a polypeptide comprising any of SEQ ID NO: 4, 12, 16, 90, 198, 352, 412 and/or 418, and/or a variant thereof, and/or an immunogenic fragment thereof) using conventional methods is immobilized on beads, mixed with cell culture media under conditions in which the variant phosphopentomutase is bound, and precipitated. In a related approach, immunochromatography finds use.

In some embodiments, the variant phosphopentomutases are expressed as a fusion protein including a non-enzyme portion. In some embodiments, the variant phosphopentomutase sequence is fused to a purification facilitating domain. As used herein, the term "purification facilitating domain" refers to a domain that mediates purification of the polypeptide to which it is fused. Suitable purification domains include, but are not limited to metal chelating peptides, histidine-tryptophan modules that allow purification on immobilized metals, a sequence which binds glutathione (e.g., GST), a hemagglutinin (HA) tag (corresponding to an epitope derived from the influenza hemagglutinin protein; See e.g., Wilson et al., Cell 37:767 [1984]), maltose binding protein sequences, the FLAG epitope utilized in the FLAGS extension/affinity purification system (e.g., the system available from Immunex Corp), and the like. One expression vector contemplated for use in the compositions and methods described herein provides for expression of a fusion protein comprising a polypeptide of the invention fused to a polyhistidine region separated by an enterokinase cleavage site. The histidine residues facilitate purification on IMIAC (immobilized metal ion affinity chromatography; See e.g., Porath et al., Prot. Exp. Purif., 3:263-281) [1992]) while the enterokinase cleavage site provides a means for separating the variant phosphopentomutase polypeptide from the fusion protein. pGEX vectors (Promega) may also be used to express foreign polypeptides as fusion proteins with glutathione 5-transferase (GST). In general, such fusion proteins are soluble and can easily be purified from lysed cells by adsorption to ligand-agarose beads (e.g., glutathione-agarose in the case of GST-fusions) followed by elution in the presence of free ligand.

Accordingly, in another aspect, the present invention provides methods of producing the engineered enzyme polypeptides, where the methods comprise culturing a host cell capable of expressing a polynucleotide encoding the engineered enzyme polypeptide under conditions suitable for expression of the polypeptide. In some embodiments, the methods further comprise the steps of isolating and/or purifying the enzyme polypeptides, as described herein.

Appropriate culture media and growth conditions for host cells are well known in the art. It is contemplated that any suitable method for introducing polynucleotides for expression of the enzyme polypeptides into cells will find use in the present invention. Suitable techniques include, but are not limited to electroporation, biolistic particle bombardment, liposome mediated transfection, calcium chloride transfection, and protoplast fusion.

Various features and embodiments of the present invention are illustrated in the following representative examples, which are intended to be illustrative, and not limiting.

EXPERIMENTAL

The following Examples, including experiments and results achieved, are provided for illustrative purposes only and are not to be construed as limiting the present invention. Indeed, there are various suitable sources for many of the reagents and equipment described below. It is not intended that the present invention be limited to any particular source for any reagent or equipment item.

In the experimental disclosure below, the following abbreviations apply: M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); psi and PSI (pounds per square inch); ° C. (degrees Centigrade); RT and rt (room temperature); CV (coefficient of variability); CAM and cam (chloramphenicol); PMBS (polymyxin B sulfate); IPTG (isopropyl β-D-1-thiogalactopyranoside); LB (lysogeny broth); TB (terrific broth); SFP (shake flask powder); CDS (coding sequence); DNA (deoxyribonucleic acid); RNA (ribonucleic acid); nt (nucleotide; polynucleotide); aa (amino acid; polypeptide); *E. coli* W3110 (commonly used laboratory *E. coli* strain, available from the *Coli* Genetic Stock Center [CGSC], New Haven, CT); HTP (high throughput); HPLC (high pressure liquid chromatography); HPLC-UV (HPLC-Ultraviolet Visible Detector); 1H NMR (proton nuclear magnetic resonance spectroscopy); FIOPC (fold improvements over positive control); Sigma and Sigma-Aldrich (Sigma-Aldrich, St. Louis, MO; Difco (Difco Laboratories, BD Diagnostic Systems, Detroit, MI); Microfluidics (Microfluidics, Westwood, MA); Life Technologies (Life Technologies, a part of Fisher Scientific, Waltham, MA); Amresco (Amresco, LLC, Solon, OH); Carbosynth (Carbosynth, Ltd., Berkshire, UK); Varian (Varian Medical Systems, Palo Alto, CA); Agilent (Agilent Technologies, Inc., Santa Clara, CA); Infors (Infors USA Inc., Annapolis Junction, MD); and Thermotron (Thermotron, Inc., Holland, MI).

Example 1

Preparation of HTP PPM Containing Wet Cell Pellets

The parent gene for the PPM (SEQ ID NO: 2) enzyme used to produce the variants of the present invention was obtained from the *E. coli* genome and cloned into a pCK110900 vector. W3110 *E. coli* cells were transformed with the respective plasmid containing the PPM encoding gene and plated on LB agar plates containing 1% glucose and 30 μg/ml chloramphenicol (CAM), and grown overnight at 37° C. Monoclonal colonies were picked and inoculated into 180 μl LB containing 1% glucose and 30 μg/mL chloramphenicol and placed in the wells of 96-well shallow-well microtiter plates. The plates were sealed with $O_2$-permeable seals, and cultures were grown overnight at 30° C., 200 rpm, and 85% humidity. Then, 10 μl of each of the cell cultures were transferred into the wells of 96-well deep-well plates containing 390 μl TB and 30 μg/mL CAM. The deep-well plates were sealed with $O_2$-permeable seals and incubated at 30° C., 250 rpm, and 85% humidity until $OD_{600}$ 0.6-0.8 was reached. The cell cultures were then induced by adding isopropyl thioglycoside (IPTG) to a final concentration of 1 mM and incubated overnight at 30° C. with 250 rpm shaking. The cells were then pelleted using centrifugation at 4,000 rpm for 10 min. The supernatants were discarded and the pellets frozen at −80° C. prior to lysis.

Example 2

Preparation of HTP PPM-Containing Cell Lysates

Frozen pellets prepared as described in Example 1 were lysed with 400 μl lysis buffer containing 100 mM triethanolamine buffer, pH 7.5, 1 mg/mL lysozyme, 0.5 mg/mL PMBS. The lysis mixture was shaken at room temperature for 2 hours. The plate was then centrifuged for 15 min at 4,000 rpm and 4° C. The supernatants were then used in biocatalytic reactions as clarified lysate to determine the activity levels.

Example 3

Preparation of Lyophilized Lysates from Shake Flask (SF) Cultures

A single colony containing the desired gene picked from an LB agar plate with 1% glucose and 30 μg/ml CAM and incubated overnight at 37° C. was transferred to 6 ml of LB with 1% glucose and 30 μg/ml CAM. The culture was grown for 18 h at 30° C., 250 rpm, and subcultured approximately 1:50 into 250 ml of TB containing 30 μg/ml CAM, to a final $OD_{600}$ of about 0.05. The subculture was grown for approximately 195 minutes at 30° C., 250 rpm, to an $OD_{600}$ between 0.6-0.8, and induced with 1 mM IPTG. The subculture was then grown for 20 h at 30° C. and 250 rpm. The subculture was centrifuged at 4,000 rpm for 20 min. The supernatant was discarded, and the pellet was resuspended in 35 ml of 25 mM triethanolamine buffer, pH 7.5. The cells were lysed using a Microfluidizer® processor system (Microfluidics) at 18,000 psi. The lysate was pelleted (10,000 rpm for 60 min), and the supernatant was frozen and lyophilized to generate shake flake (SF) enzyme powder.

Example 4

Improved Phosphopentomutase Variants of SEQ ID NO: 4 for Production of Compound (1)

The engineered polynucleotide (SEQ ID NO: 3) encoding the polypeptide with phosphopentomutase activity of SEQ ID NO: 4 was used to generate the engineered polypeptides of Table 4.1. These polypeptides displayed improved phosphopentomutase activity under the desired conditions (e.g. ability to produce compound (3) as measured via the production of compound (1) in the presence of SP and engineered DERA and PNP enzymes as shown in Scheme I, above), as compared to the starting polypeptide.

The engineered polypeptides, having the amino acid sequences of even-numbered sequence identifiers were generated from the "backbone" amino acid sequence of SEQ ID NO: 4 as described below. Directed evolution began with the polynucleotide set forth in SEQ ID NO: 3. Libraries of engineered polypeptides were generated using various well-known techniques (e.g., saturation mutagenesis, recombination of previously identified beneficial amino acid differences) and were screened using HTP assay and analysis methods that measured the polypeptides' phosphopentomutase activity. In this case, activity was measured via the production of compound (1) in the presence of sucrose phosphorylase (SP), engineered deoxyribose-phosphate aldolase (DERA), and purine nucleoside phosphorylase (PNP) enzymes, as shown in Scheme I, using the analytical method in Table 13.1. The method provided herein finds use in analyzing the variants produced using the present invention. However, it is not intended that the methods described herein are the only methods applicable to the analysis of the variants provided herein and/or produced using the methods provided herein, as other suitable methods find use in the present invention.

High throughput lysates were prepared as follows. Frozen pellets from clonal PPM variants were prepared as described in Example 1 and were lysed with 400 μl lysis buffer as described in Example 2. The lysis mixture was shaken at room temperature for 2 hours. The plate was then centrifuged for 15 min at 4,000 rpm and 4° C.

Reactions were performed in a tandem 4-enzyme cascade setup involving DERA/PPM/PNP/SP enzymes in a 96-well format in 2 mL deep-well plates, with 100 μL total volume. Reactions included DERA, PNP, and SP as shake flask powders (0.5 wt % evolved DERA—DERA SEQ ID NO: 548, 0.5 wt % evolved PNP—PNP SEQ ID NO: 550, and 0.5 wt % evolved SP—SP SEQ ID NO: 552), 26 g/L or 124 mM of enantiopure (R)-2-ethynyl-glyceraldehyde substrate, 99 mM F-adenine (0.8 eq.), 186 mM acetaldehyde (40 wt % in isopropanol, 1.5 eq.), 372 mM sucrose (3.0 eq.), 5 mM $MnCl_2$, and 50 mM TEoA, pH 7.5. The reactions were set up as follows: (i) all the reaction components, except for PPM, were pre-mixed in a single solution, and 90 μL of this solution were then aliquoted into each well of the 96-well plates (ii) 10 μL of PPM lysate were then added into the wells to initiate the reaction. The reaction plate was heat-sealed and incubated at 35° C. with 600 rpm shaking for 18-20 hours.

The reactions were quenched with 300 μL 1:1 mixture of 1M KOH and DMSO. The quenched reactions were shaken for 10 min on a tabletop shaker, followed by centrifugation at 4,000 rpm for 5 min at 4° C. to pellet any precipitate. Ten microliters of the supernatant were then transferred into a 96-well round bottom plate prefilled with 190 μL of 25% MeCN in 0.1 M TEoA, pH 7.5 buffer. The samples were injected onto a Thermo U3000 UPLC system and were separated using an Atlantis T3 C18, 3 μm, 2.1×100 mm column isocratically with a mobile phase containing 75:25 water:acetonitrile supplemented with 0.1% TFA, as described in Example 13, Table 13.1. Activity relative to SEQ ID NO: 4 was calculated as the peak area of compound (1) formed by the variant enzyme, compared to peak area of compound (1) formed by SEQ ID NO: 4, under the specified reaction conditions.

TABLE 4.1

| SEQ ID NO: (nt/aa) | Amino Acid Differences (Relative to SEQ ID NO: 4) | FIOP Relative to SEQ ID NO: 4 |
|---|---|---|
| 5/6 | D188E/A257V/N266G/S334A/K355P | ++ |
| 7/8 | R22K/N137G/A257V/N266G | ++ |
| 9/10 | R22K/S68A/C180A/D188E/A257V/N266G | ++ |
| 11/12 | R22K/D188E/A257V/N266G/I341L | ++ |
| 13/14 | A257V/K355P | + |
| 15/16 | R22K/C180A/D188E/A257V/S334A | + |
| 17/18 | R22K/S68A/A257V/N266G | + |
| 19/20 | R22K/A257V/N266G | + |
| 21/22 | S308L | + |
| 23/24 | R22K/A257V/K355P | + |
| 25/26 | D188E/A257V/N266G/S334A | + |
| 27/28 | A257V/I341L | + |
| 29/30 | V82P/S308L | + |
| 31/32 | V82P/M92L/E192T/S308L | + |
| 33/34 | T151E/Q225K/H251G/G256S/A257V/K287E/K355T/E357T/L391V | + |

Levels of increased activity were determined relative to the reference polypeptide of SEQ ID NO: 4 and defined as follows: "+" 1.15 to 1.30, "++" >1.35

Example 5

Improved Phosphopentomutase Variants of SEQ ID NO: 12 for Production of Compound (1)

The engineered polynucleotide (SEQ ID NO: 11) encoding the polypeptide with phosphopentomutase activity of SEQ ID NO: 12 was used to generate the engineered polypeptides of Table 5.1. These polypeptides displayed improved phosphopentomutase activity under the desired conditions (e.g. ability to produce compound (3) as measured via the production of compound (1) in the presence of SP and engineered DERA and PNP enzymes, as shown in Scheme I), as compared to the starting polypeptide.

The engineered polypeptides, having the amino acid sequences of even-numbered sequence identifiers were generated from the "backbone" amino acid sequence of SEQ ID NO: 12, as described below. Directed evolution began with the polynucleotide set forth in SEQ ID NO: 11. Libraries of engineered polypeptides were generated using various well-known techniques (e.g., saturation mutagenesis, recombination of previously identified beneficial amino acid differences) and were screened using HTP assay and analysis methods that measured the polypeptides' phosphopentomutase activity. In this case, activity was measured via the production of compound (1) in the presence of sucrose SP and engineered DERA and PNP enzymes, as shown in Scheme I, using the analytical method in Table 13.1. The method provided herein finds use in analyzing the variants produced using the present invention. However, it is not intended that the methods described herein are the only methods applicable to the analysis of the variants provided herein and/or produced using the methods provided herein, as other suitable methods find use in the present invention.

High throughput lysates were prepared as follows. Frozen pellets from clonal PPM variants were prepared, as described in Example 1, and were lysed with 400 μl lysis buffer, as described in Example 2. The lysis mixture was shaken at room temperature for 2 hours. The plate was then centrifuged for 15 min at 4,000 rpm and 4° C.

Reactions were performed in a tandem 4-enzyme cascade setup involving DERA/PPM/PNP/SP enzymes in a 96-well format in 2 mL deep-well plates, with 100 μL total volume. Reactions included DERA, PNP, and SP as shake flask powders (0.5 wt % evolved DERA—DERA SEQ ID NO: 548, 0.5 wt % evolved PNP—PNP SEQ ID NO: 550, and 0.5 wt % evolved SP—SP SEQ ID NO: 552), 26 g/L or 124 mM of enantiopure (R)-2-ethynyl-glyceraldehyde substrate, 99 mM F-adenine (0.8 eq.), 186 mM acetaldehyde (40 wt % in isopropanol, 1.5 eq.), 372 mM sucrose (3.0 eq.), 5 mM $MnCl_2$, and 50 mM TEoA, pH 7.5. The reactions were set up as follows: (i) all the reaction components, except for PPM, were pre-mixed in a single solution, and 90 μL of this solution were then aliquoted into each well of the 96-well plates (ii) 10 μL of PPM lysate were then added into the wells to initiate the reaction. The reaction plate was heat-sealed and incubated at 35° C. with 600 rpm shaking for 18-20 hours.

The reactions were quenched with 300 μL 1:1 mixture of 1M KOH and DMSO. The quenched reactions were shaken for 10 min on a tabletop shaker followed by centrifugation at 4,000 rpm for 5 min at 4° C. to pellet any precipitate. Ten microliters of the supernatant were then transferred into a 96-well round bottom plate prefilled with 190 μL of 25% MeCN in 0.1 M TEoA, pH 7.5 buffer. The samples were injected onto a Thermo U3000 UPLC system and were separated using an Atlantis T3 C18, 3 μm, 2.1×100 mm column isocratically with a mobile phase containing 75:25 water:acetonitrile supplemented with 0.1% TFA, as described in Example 13, Table 13.1. Activity relative to SEQ ID NO: 12 was calculated as the peak area of compound (1) formed by the variant enzyme, compared to peak area of compound (1) formed by SEQ ID NO: 12, under the specified reaction conditions.

TABLE 5.1

| SEQ ID NO: (nt/aa) | Amino Acid Differences (Relative to SEQ ID NO: 12) | FIOP Relative to SEQ ID NO: 12 |
|---|---|---|
| 35/36 | Q244F | +++ |
| 37/38 | A265S | +++ |
| 39/40 | T150V | ++ |
| 41/42 | I235Q | ++ |
| 43/44 | I235K | ++ |
| 45/46 | G239V | ++ |
| 47/48 | G239S | ++ |
| 49/50 | K118R | ++ |
| 51/52 | G239A | + |
| 53/54 | R267S | + |
| 55/56 | Q155L | + |
| 57/58 | K355V | + |
| 59/60 | K22A | + |
| 61/62 | G266E | + |
| 63/64 | I263L | + |
| 65/66 | G238T | + |
| 67/68 | G238S | + |
| 69/70 | R267T | + |
| 71/72 | Y191M | + |
| 73/74 | G238Q | + |
| 75/76 | R267V | + |
| 77/78 | A284T | + |
| 79/80 | G256A | + |
| 81/82 | G239R | + |
| 83/84 | Q244S | + |
| 85/86 | G266N | + |
| 87/88 | A284V | + |

Levels of increased activity were determined relative to the reference polypeptide of SEQ ID NO: 12 and defined as follows: "+" 1.00 to 1.30, "++" >1.30, "+++" >1.50

Example 6

Improved Phosphopentomutase Variants of SEQ ID NO: 16 for Production of Compound (1)

The engineered polynucleotide (SEQ ID NO: 15) encoding the polypeptide with phosphopentomutase activity of SEQ ID NO: 16 was used to generate the engineered polypeptides of Table 5.1. These polypeptides displayed improved phosphopentomutase activity under the desired conditions (e.g. ability to produce compound (3) as measured via the production of compound (1) in the presence of SP and engineered DERA and PNP enzymes, as shown in Scheme I), as compared to the starting polypeptide.

The engineered polypeptides, having the amino acid sequences of even-numbered sequence identifiers were generated from the "backbone" amino acid sequence of SEQ ID NO: 16, as described below. Directed evolution began with the polynucleotide set forth in SEQ ID NO: 15. Libraries of engineered polypeptides were generated using various well-known techniques (e.g., saturation mutagenesis, recombination of previously identified beneficial amino acid differences) and were screened using HTP assay and analysis methods that measured the polypeptides' phosphopentomutase activity. In this case, activity was measured via the production of compound (1) in the presence of SP and engineered DERA and PNP enzymes, as shown in Scheme I, using the analytical method in Table 13.1. The method provided herein finds use in analyzing the variants produced using the present invention. However, it is not intended that the methods described herein are the only methods applicable to the analysis of the variants provided herein and/or produced using the methods provided herein, as other suitable methods find use in the present invention.

High throughput lysates were prepared as follows. Frozen pellets from clonal PPM variants were prepared, as described in Example 1, and were lysed with 400 μl lysis buffer, as described in Example 2. The lysis mixture was shaken at room temperature for 2 hours. The plate was then centrifuged for 15 min at 4,000 rpm and 4° C.

Reactions were performed in a tandem 4-enzyme cascade setup involving DERA/PPM/PNP/SP enzymes in a 96-well format in 2 mL deep-well plates, with 100 μL total volume.

Reactions included DERA, PNP, and SP as shake flask powders (0.5 wt % evolved DERA—DERA SEQ ID NO: 548, 0.5 wt % evolved PNP—PNP SEQ ID NO: 550, and 0.5 wt % evolved SP—SP SEQ ID NO: 552), 26 g/L or 124 mM of enantiopure (R)-2-ethynyl-glyceraldehyde substrate, 99 mM F-adenine (0.8 eq.), 186 mM acetaldehyde (40 wt % in isopropanol, 1.5 eq.), 372 mM sucrose (3.0 eq.), 5 mM $MnCl_2$, and 50 mM TEoA, pH 7.5. The reactions were set up as follows: (i) all the reaction components, except for PPM, were pre-mixed in a single solution, and 90 μL of this solution were then aliquoted into each well of the 96-well plates (ii) 10 μL of PPM lysate were then added into the wells to initiate the reaction. The reaction plate was heat-sealed and incubated at 35° C. with 600 rpm shaking for 18-20 hours.

The reactions were quenched with 300 μL 1:1 mixture of 1M KOH and DMSO. The quenched reactions were shaken for 10 min on a tabletop shaker followed by centrifugation at 4,000 rpm for 5 min at 4° C. to pellet any precipitate. Ten microliters of the supernatant were then transferred into a 96-well round bottom plate prefilled with 190 μL of 25% MeCN in 0.1 M TEoA, pH 7.5 buffer. The samples were injected onto a Thermo U3000 UPLC system and were separated using an Atlantis T3 C18, 3 μm, 2.1×100 mm column isocratically with a mobile phase containing 75:25 water:acetonitrile supplemented with 0.1% TFA, as described in Example 13, Table 13.1. Activity relative to SEQ ID NO: 16 was calculated as the peak area of compound (1) formed by the variant enzyme, compared to peak area of compound (1) formed by SEQ ID NO: 16 under the specified reaction conditions.

TABLE 6.1

| SEQ ID NO: (nt/aa) | Amino Acid Differences (Relative to SEQ ID NO: 16) | FIOP Relative to SEQ ID NO: 16 |
|---|---|---|
| 89/90 | E188D/I235Q/S308L | +++ |
| 91/92 | I235Q | +++ |
| 93/94 | Q155L/I235Q | ++ |
| 95/96 | T150V/I235Q/G239A/A334S | ++ |
| 97/98 | T150V/E188D/I235Q/G239A/A334S | + |
| 99/100 | K22R/V82P/G238T | + |
| 101/102 | E188D/S308L | + |
| 103/104 | I235Q/G239A/Q244F | + |
| 105/106 | G238T/G256A | + |
| 107/108 | G239S/S308L | + |
| 109/110 | I235Q/G239S | + |
| 111/112 | E188D/G239S/N266E | + |
| 113/114 | E188D/G239S/S308L | + |
| 115/116 | E188D/S308L/A334S | + |
| 117/118 | Q155L/I235Q/G239S | + |
| 119/120 | T150V/I235Q/G239S | + |
| 121/122 | S308L | + |
| 123/124 | T150V/Q155L/A180C/G239A | + |
| 125/126 | A180C/A334S | + |
| 127/128 | T150V/Q155L/E188D/I235Q/A334S | + |
| 129/130 | K22R/G238T | + |
| 131/132 | G239S | + |
| 133/134 | A180C/E188D/G239S/A334S | + |
| 135/136 | Q155L/E188D/I235Q/G239S | + |
| 137/138 | G238S | + |
| 139/140 | K22R/V82P | + |
| 141/142 | G238T | + |
| 143/144 | G238S/A316T | + |
| 145/146 | K22R/Y191M/G238S/G256A | + |
| 147/148 | T150V | + |
| 149/150 | V82P/K118R/Y191M | + |
| 151/152 | V82P/G238T | + |
| 153/154 | I235Q/G239S/Q244F | + |
| 155/156 | K118R/Y191M | + |
| 157/158 | V82P/K118R/G238T | + |
| 159/160 | V82P/G238S | + |
| 161/162 | T150V/Q155L/I235Q/G239S/A334S | + |

TABLE 6.1-continued

| SEQ ID NO: (nt/aa) | Amino Acid Differences (Relative to SEQ ID NO: 16) | FIOP Relative to SEQ ID NO: 16 |
|---|---|---|
| 163/164 | E188D/G239A/A265S/S308L | + |
| 165/166 | S308L/A334S | + |
| 167/168 | A334S | + |
| 169/170 | Q155L/I235Q/G239S/Q244F | + |
| 171/172 | T150V/A180C/E188D | + |
| 173/174 | K22R/K118R/G256A | + |
| 175/176 | K118R/G238T | + |
| 177/178 | V82P/G238Q/G256A | + |
| 179/180 | A265S | + |

Levels of increased activity were determined relative to the reference polypeptide of SEQ ID NO: 16 and defined as follows: "+" 1.00 to 1.20, "++" >1.20, "+++" >1.40

Example 7

Improved Phosphopentomutase Variants of SEQ ID NO: 90 for Production of Compound (1)

The engineered polynucleotide (SEQ ID NO: 89) encoding the polypeptide with phosphopentomutase activity of SEQ ID NO: 90 was used to generate the engineered polypeptides of Table 5.1. These polypeptides displayed improved phosphopentomutase activity under the desired conditions (e.g. ability to produce compound (3) as measured via the production of compound (1) in the presence of SP and engineered DERA and PNP enzymes, as shown in Scheme I), as compared to the starting polypeptide.

The engineered polypeptides, having the amino acid sequences of even-numbered sequence identifiers were generated from the "backbone" amino acid sequence of SEQ ID NO: 90, as described below. Directed evolution began with the polynucleotide set forth in SEQ ID NO: 89. Libraries of engineered polypeptides were generated using various well-known techniques (e.g., saturation mutagenesis, recombination of previously identified beneficial amino acid differences) and were screened using HTP assay and analysis methods that measured the polypeptides' phosphopentomutase activity. In this case, activity was measured via the production of compound (1) in the presence of SP and engineered DERA and PNP enzymes, as shown in Scheme I, using the analytical method in Table 13.1. The method provided herein finds use in analyzing the variants produced using the present invention. However, it is not intended that the methods described herein are the only methods applicable to the analysis of the variants provided herein and/or produced using the methods provided herein, as other suitable methods find use in the present invention.

High throughput lysates were prepared as follows. Frozen pellets from clonal PPM variants were prepared, as described in Example 1, and were lysed with 400 μl lysis buffer, as described in Example 2. The lysis mixture was shaken at room temperature for 2 hours. The plate was then centrifuged for 15 min at 4,000 rpm and 4° C.

Reactions were performed in a tandem 4-enzyme cascade setup involving DERA/PPM/PNP/SP enzymes in a 96-well format in 2 mL deep-well plates, with 100 μL total volume. Reactions included DERA, PNP, and SP as shake flask powders (0.5 wt % evolved DERA—DERA SEQ ID NO: 548, 0.5 wt % evolved PNP—PNP SEQ ID NO: 550, and 0.5 wt % evolved SP—SP SEQ ID NO: 552), 26 g/L or 124 mM of enantiopure (R)-2-ethynyl-glyceraldehyde substrate, 99 mM F-adenine (0.8 eq.), 186 mM acetaldehyde (40 wt % in isopropanol, 1.5 eq.), 372 mM sucrose (3.0 eq.), 2.5 mM $MnCl_2$, and 50 mM TEoA, pH 7.5. The reactions were set up as follows: (i) all the reaction components, except for PPM, were pre-mixed in a single solution, and 90 μL of this solution were then aliquoted into each well of the 96-well plates (ii) 10 μL of PPM lysate were then added into the wells to initiate the reaction. The reaction plate was heat-sealed and incubated at 35° C. with 600 rpm shaking for 18-20 hours.

The reactions were quenched with 300 μL 1:1 mixture of 1M KOH and DMSO. The quenched reactions were shaken for 10 min on a tabletop shaker followed by centrifugation at 4,000 rpm for 5 min at 4° C. to pellet any precipitate. Ten microliters of the supernatant were then transferred into a 96-well round bottom plate prefilled with 190 μL of 25% MeCN in 0.1 M TEoA, pH 7.5 buffer. The samples were injected onto a Thermo U3000 UPLC system and were separated using an Atlantis T3 C18, 3 μm, 2.1×100 mm column isocratically with a mobile phase containing 75:25 water:acetonitrile supplemented with 0.1% TFA, as described in Example 13, Table 13.1. Activity relative to SEQ ID NO: 90 was calculated as the peak area of compound (1) formed by the variant enzyme, compared to peak area of compound (1) formed by SEQ ID NO: 90 under the specified reaction conditions.

TABLE 7.1

| SEQ ID NO: (nt/aa) | Amino Acid Differences (Relative to SEQ ID NO: 90) | FIOP Relative to SEQ ID NO: 90 |
|---|---|---|
| 181/182 | K118L | ++ |
| 183/184 | Y369L | ++ |
| 185/186 | K287C | ++ |
| 187/188 | V82K | ++ |
| 189/190 | Q225V | ++ |
| 191/192 | D77R | ++ |
| 193/194 | K287L | ++ |
| 195/196 | Y394L | ++ |
| 197/198 | M114Q | ++ |
| 199/200 | V82D | ++ |
| 201/202 | L391V | ++ |
| 203/204 | L391A | ++ |
| 205/206 | R135K | + |
| 207/208 | D77Q | + |
| 209/210 | Q155Y | + |
| 211/212 | V53T | + |
| 213/214 | H65A | + |
| 215/216 | Y369W | + |
| 217/218 | L120V | + |
| 219/220 | T397C | + |
| 221/222 | R267K | + |
| 223/224 | H251R | + |
| 225/226 | R267Q | + |
| 227/228 | L120R | + |
| 229/230 | H65G | + |
| 231/232 | Q155M | + |
| 233/234 | E357M | + |
| 235/236 | Q155V | + |
| 237/238 | E172A | + |
| 239/240 | G222S | + |
| 241/242 | A16S | + |
| 243/244 | H251T | + |
| 245/246 | N52S | + |
| 247/248 | Y191I | + |
| 249/250 | Y369V | + |
| 251/252 | H251S | + |
| 253/254 | Q155D | + |
| 255/256 | N52V | + |
| 257/258 | V53A | + |
| 259/260 | N52K | + |
| 261/262 | K118I | + |
| 263/264 | Q244A | + |
| 265/266 | K189S | + |
| 267/268 | K22M | + |
| 269/270 | Q155R | + |
| 271/272 | V133T | + |
| 273/274 | T397I | + |
| 275/276 | K287G | + |

TABLE 7.1-continued

| SEQ ID NO: (nt/aa) | Amino Acid Differences (Relative to SEQ ID NO: 90) | FIOP Relative to SEQ ID NO: 90 |
|---|---|---|
| 277/278 | A334C | + |
| 279/280 | D77E | + |
| 281/282 | L120P | + |
| 283/284 | R135L | + |
| 285/286 | N52E | + |
| 287/288 | E21I | + |
| 289/290 | L156V | + |
| 291/292 | K220V | + |
| 293/294 | D77A | + |
| 295/296 | D188A | + |
| 297/298 | V53G | + |
| 299/300 | T397V | + |
| 301/302 | A261G | + |
| 303/304 | T397L | + |
| 305/306 | V133L | + |
| 307/308 | H251V | + |
| 309/310 | Q244K | + |
| 311/312 | K220R | + |
| 313/314 | Q155E | + |
| 315/316 | T397E | + |
| 317/318 | E236P | + |
| 319/320 | H251Y | + |
| 321/322 | A221H | + |
| 323/324 | D77T | + |
| 325/326 | A284T | + |
| 327/328 | T397D | + |
| 329/330 | E21Q | + |
| 331/332 | G222L | + |
| 333/334 | A221E | + |
| 335/336 | L156E | + |
| 337/338 | V257L | + |
| 339/340 | V82A | + |

Levels of increased activity were determined relative to the reference polypeptide of SEQ ID NO: 90 and defined as follows: "+" 1.00 to 1.10, "++" >1.10

Example 8

Improved Phosphopentomutase Variants of SEQ ID NO: 90 for Production of Compound (1)

The engineered polynucleotide (SEQ ID NO: 89) encoding the polypeptide with phosphopentomutase activity of SEQ ID NO: 90 was used to generate the engineered polypeptides of Table 5.1. These polypeptides displayed improved phosphopentomutase activity under the desired conditions (e.g. ability to produce compound (3) as measured via the production of compound (1) in the presence of SP and engineered DERA and PNP enzymes, as shown in Scheme I), as compared to the starting polypeptide.

The engineered polypeptides, having the amino acid sequences of even-numbered sequence identifiers were generated from the "backbone" amino acid sequence of SEQ ID NO: 90, as described below. Directed evolution began with the polynucleotide set forth in SEQ ID NO: 89. Libraries of engineered polypeptides were generated using various well-known techniques (e.g., saturation mutagenesis, recombination of previously identified beneficial amino acid differences) and were screened using HTP assay and analysis methods that measured the polypeptides' phosphopentomutase activity. In this case, activity was measured via the production of compound (1) in the presence of SP and DERA and PNP enzymes, as shown in Scheme I, using the analytical method in Table 13.1. The method provided herein finds use in analyzing the variants produced using the present invention. However, it is not intended that the methods described herein are the only methods applicable to the analysis of the variants provided herein and/or produced using the methods provided herein, as other suitable methods find use in the present invention.

High throughput lysates were prepared as follows. Frozen pellets from clonal PPM variants were prepared, as described in Example 1, and were lysed with 400 μl lysis buffer, as described in Example 2. The lysis mixture was shaken at room temperature for 2 hours. The plate was then centrifuged for 15 min at 4,000 rpm and 4° C.

Reactions were performed in a tandem 4-enzyme cascade setup involving DERA/PPM/PNP/SP enzymes in a 96-well format in 2 mL deep-well plates, with 100 μL total volume. Reactions included DERA, PNP, and SP as shake flask powders (0.5 wt % evolved DERA—DERA SEQ ID NO: 548, 0.5 wt % evolved PNP—PNP SEQ ID NO: 550, and 0.5 wt % evolved SP—SP SEQ ID NO: 552), 26 g/L or 124 mM of enantiopure (R)-2-ethynyl-glyceraldehyde substrate, 99 mM F-adenine (0.8 eq.), 186 mM acetaldehyde (40 wt % in isopropanol, 1.5 eq.), 372 mM sucrose (3.0 eq.), 5 mM $MnCl_2$, and 50 mM TEoA, pH 7.5. The reactions were set up as follows: (i) all the reaction components, except for PPM, were pre-mixed in a single solution, and 90 μL of this solution were then aliquoted into each well of the 96-well plates (ii) 10 μL of PPM lysate were then added into the wells to initiate the reaction. The reaction plate was heat-sealed and incubated at 35° C. with 600 rpm shaking for 18-20 hours.

The reactions were quenched with 300 μL 1:1 mixture of 1M KOH and DMSO. The quenched reactions were shaken for 10 min on a tabletop shaker followed by centrifugation at 4,000 rpm for 5 min at 4° C. to pellet any precipitate. Ten microliters of the supernatant were then transferred into a 96-well round bottom plate prefilled with 190 μL of 25% MeCN in 0.1 M TEoA, pH 7.5 buffer. The samples were injected onto a Thermo U3000 UPLC system and were separated using an Atlantis T3 C18, 3 μm, 2.1×100 mm column isocratically with a mobile phase containing 75:25 water:acetonitrile supplemented with 0.1% TFA, as described in Example 13, Table 13.1. Activity relative to SEQ ID NO: 90 was calculated as the peak area of compound (1) formed by the variant enzyme, compared to peak area of compound (1) formed by SEQ ID NO: 90 under the specified reaction conditions.

TABLE 8.1

| SEQ ID NO: (nt/aa) | Amino Acid Differences (Relative to SEQ ID NO: 90) | FIOP Relative to SEQ ID NO: 90 |
|---|---|---|
| 341/342 | L308V | ++ |
| 343/344 | E21W/N79D/L308V | ++ |
| 345/346 | N266G/T276S/K287V/L308V | ++ |
| 347/348 | A261I | ++ |
| 349/350 | A261V | ++ |
| 351/352 | N266G/L308V | + |
| 353/354 | E21W/T276S/C301N | + |
| 355/356 | L156W | + |
| 357/358 | A179G | + |
| 359/360 | A147G | + |
| 201/202 | L391V | + |
| 239/240 | G222S | + |
| 335/336 | L156E | + |
| 361/362 | G239V | + |
| 325/326 | A284T | + |
| 279/280 | D77E | + |
| 363/364 | K355T | + |
| 365/366 | K272G | + |

TABLE 8.1-continued

| SEQ ID NO: (nt/aa) | Amino Acid Differences (Relative to SEQ ID NO: 90) | FIOP Relative to SEQ ID NO: 90 |
|---|---|---|
| 311/312 | K220R | + |
| 367/368 | F117W | + |
| 369/370 | T150S | + |
| 333/334 | A221E | + |
| 371/372 | C301N | + |

Levels of increased activity were determined relative to the reference polypeptide of SEQ ID NO: 90 and defined as follows: "+" 1.00 to 1.10, "++" >1.10

Example 9

Improved Phosphopentomutase Variants of SEQ ID NO: 198 for Production of Compound (1)

The engineered polynucleotide (SEQ ID NO: 197) encoding the polypeptide with phosphopentomutase activity of SEQ ID NO: 198 was used to generate the engineered polypeptides of Table 5.1. These polypeptides displayed improved phosphopentomutase activity under the desired conditions (e.g. ability to produce compound (3) as measured via the production of compound (1) in the presence of SP and engineered DERA and PNP enzymes, as shown in Scheme I), as compared to the starting polypeptide.

The engineered polypeptides, having the amino acid sequences of even-numbered sequence identifiers were generated from the "backbone" amino acid sequence of SEQ ID NO: 198, as described below. Directed evolution began with the polynucleotide set forth in SEQ ID NO: 197. Libraries of engineered polypeptides were generated using various well-known techniques (e.g., saturation mutagenesis, recombination of previously identified beneficial amino acid differences) and were screened using HTP assay and analysis methods that measured the polypeptides' phosphopentomutase activity. In this case, activity was measured via the production of compound (1) in the presence of SP and engineered DERA and PNP enzymes, as shown in Scheme I, using the analytical method in Table 13.1. The method provided herein finds use in analyzing the variants produced using the present invention. However, it is not intended that the methods described herein are the only methods applicable to the analysis of the variants provided herein and/or produced using the methods provided herein, as other suitable methods find use in the present invention.

High throughput lysates were prepared as follows. Frozen pellets from clonal PPM variants were prepared, as described in Example 1, and were lysed with 400 μl lysis buffer, as described in Example 2. The lysis mixture was shaken at room temperature for 2 hours. The plate was then centrifuged for 15 min at 4,000 rpm and 4° C.

Reactions were performed in a tandem 4-enzyme cascade setup involving DERA/PPM/PNP/SP enzymes in a 96-well format in 2 mL deep-well plates, with 100 μL total volume. Reactions included DERA, PNP, and SP as shake flask powders (0.5 wt % evolved DERA—DERA SEQ ID NO: 548, 0.5 wt % evolved PNP—PNP SEQ ID NO: 550, and 0.5 wt % evolved SP—SP SEQ ID NO: 552), 26 g/L or 124 mM of enantiopure (R)-2-ethynyl-glyceraldehyde substrate, 99 mM F-adenine (0.8 eq.), 186 mM acetaldehyde (40 wt % in isopropanol, 1.5 eq.), 372 mM sucrose (3.0 eq.), 2.5 mM $MnCl_2$, and 50 mM TEoA, pH 7.5. The reactions were set up as follows: (i) all the reaction components, except for PPM, were pre-mixed in a single solution, and 90 μL of this solution were then aliquoted into each well of the 96-well plates (ii) 10 μL of PPM lysate were then added into the wells to initiate the reaction. The reaction plate was heat-sealed and incubated at 35° C. with 600 rpm shaking for 18-20 hours.

The reactions were quenched with 300 μL 1:1 mixture of 1M KOH and DMSO. The quenched reactions were shaken for 10 min on a tabletop shaker followed by centrifugation at 4,000 rpm for 5 min at 4° C. to pellet any precipitate. Ten microliters of the supernatant were then transferred into a 96-well round bottom plate prefilled with 190 μL of 25% MeCN in 0.1 M TEoA, pH 7.5 buffer. The samples were injected onto a Thermo U3000 UPLC system and were separated using Atlantis T3 C18, 3 μm, 2.1×100 mm column isocratically with a mobile phase containing 75:25 water: acetonitrile supplemented with 0.1% TFA, as described in Example 13, Table 13.1. Activity relative to SEQ ID NO: 198 was calculated as the peak area of compound (1) formed by the variant enzyme, compared to peak area of compound (1) formed by SEQ ID NO: 198 under the specified reaction conditions.

TABLE 9.1

| SEQ ID NO: (nt/aa) | Amino Acid Differences (Relative to SEQ ID NO: 198) | FIOP Relative to SEQ ID NO: 198 |
|---|---|---|
| 373/374 | C301N | ++ |
| 375/376 | Q114M | ++ |
| 377/378 | G228S | + |
| 379/380 | L308V | + |
| 381/382 | T276S | + |
| 383/384 | L111V | + |
| 385/386 | G205R | + |
| 387/388 | E401R | + |
| 389/390 | S94L | + |
| 391/392 | V26Q | + |
| 393/394 | L111R | + |
| 395/396 | E21W | + |
| 397/398 | K374R | + |
| 399/400 | G228A | + |
| 401/402 | V26E | + |
| 403/404 | G293R | + |
| 405/406 | K287V | + |
| 407/408 | N266G | + |
| 409/410 | A265S | + |

Levels of increased activity were determined relative to the reference polypeptide of SEQ ID NO: 198 and defined as follows: "+" 1.00 to 1.20, "++" >1.20

Example 10

Improved Phosphopentomutase Variants of SEQ ID NO: 352 for Production of Compound (1)

The engineered polynucleotide (SEQ ID NO: 351) encoding the polypeptide with phosphopentomutase activity of SEQ ID NO: 352 was used to generate the engineered polypeptides of Table 5.1. These polypeptides displayed improved phosphopentomutase activity under the desired conditions (e.g. ability to produce compound (3) as measured via the production of compound (1) in the presence of SP and engineered DERA and PNP enzymes, as shown in Scheme I), as compared to the starting polypeptide.

The engineered polypeptides, having the amino acid sequences of even-numbered sequence identifiers were generated from the "backbone" amino acid sequence of SEQ ID NO: 352, as described below. Directed evolution began with the polynucleotide set forth in SEQ ID NO: 351. Libraries of engineered polypeptides were generated using various well-known techniques (e.g., saturation mutagenesis, recombination of previously identified beneficial amino acid differences) and were screened using HTP assay and analysis methods that measured the polypeptides' phosphopentomutase activity. In this case, activity was measured via the production of compound (1) in the presence of SP and DERA and PNP enzymes, as shown in Scheme I, using the analytical method in Table 13.1. The method provided herein finds use in analyzing the variants produced using the present invention. However, it is not intended that the methods described herein are the only methods applicable to the analysis of the variants provided herein and/or produced using the methods provided herein, as other suitable methods find use in the present invention.

High throughput lysates were prepared as follows. Frozen pellets from clonal PPM variants were prepared, as described in Example 1, and were lysed with 400 μl lysis buffer, as described in Example 2. The lysis mixture was shaken at room temperature for 2 hours. The plate was then centrifuged for 15 min at 4,000 rpm and 4° C.

Reactions were performed in a tandem 4-enzyme cascade setup involving DERA/PPM/PNP/SP enzymes in a 96-well format in 2 mL deep-well plates, with 100 μL total volume. Reactions included DERA, PNP, and SP as shake flask powders (0.5 wt % evolved DERA—DERA SEQ ID NO: 548, 0.5 wt % evolved PNP—PNP SEQ ID NO: 550, and 0.5 wt % evolved SP—SP SEQ ID NO: 552), 26 g/L or 124 mM of enantiopure (R)-2-ethynyl-glyceraldehyde substrate, 99 mM F-adenine (0.8 eq.), 186 mM acetaldehyde (40 wt % in isopropanol, 1.5 eq.), 372 mM sucrose (3.0 eq.), 5 mM $MnCl_2$ and 50 mM TEoA, pH 7.5. The reactions were set up as follows: (i) all the reaction components, except for PPM, were pre-mixed in a single solution, and 90 μL of this solution were then aliquoted into each well of the 96-well plates (ii) 10 μL of PPM lysate were then added into the wells to initiate the reaction. The reaction plate was heat-sealed and incubated at 35° C. with 600 rpm shaking for 18-20 hours.

The reactions were quenched with 300 μL 1:1 mixture of 1M KOH and DMSO. The quenched reactions were shaken for 10 min on a tabletop shaker followed by centrifugation at 4,000 rpm for 5 min at 4° C. to pellet any precipitate. Ten microliters of the supernatant were then transferred into a 96-well round bottom plate prefilled with 190 μL of 25% MeCN in 0.1 M TEoA, pH 7.5 buffer. The samples were injected onto the Thermo U3000 UPLC system and were separated using an Atlantis T3 C18, 3 μm, 2.1×100 mm column isocratically with a mobile phase containing 75:25 water:acetonitrile supplemented with 0.1% TFA, as described in Example 13, Table 13.1. Activity relative to SEQ ID NO: 352 was calculated as the peak area of compound (1) formed by the variant enzyme, compared to peak area of compound (1) formed by SEQ ID NO: 352 under the specified reaction conditions.

TABLE 10.1

| SEQ ID NO: (nt/aa) | Amino Acid Differences (Relative to SEQ ID NO: 352) | FIOP Relative to SEQ ID NO: 352 |
|---|---|---|
| 411/412 | L156W/A261I/A284T | ++ |
| 413/414 | A147G/L391V | ++ |
| 415/416 | G222S/A261V/L391V | ++ |
| 417/418 | L156E/A261I/A284T/L391V | ++ |
| 419/420 | A147G/A284T/L391V | ++ |
| 421/422 | L156E/A261I | + |
| 423/424 | A147G/L156W/G222S/A261V/L391V | + |
| 425/426 | A147G/L156W/A261V/A284T | + |
| 427/428 | L156W/G222S/L391V | + |
| 429/430 | L156W/A261V/A284T | + |
| 431/432 | G222S/A261I/A284T | + |
| 433/434 | A284T/L391V | + |
| 435/436 | A147G/A261I | + |
| 437/438 | A147G/L156W/L391V | + |
| 439/440 | L156E/L391V | + |

TABLE 10.1-continued

| SEQ ID NO: (nt/aa) | Amino Acid Differences (Relative to SEQ ID NO: 352) | FIOP Relative to SEQ ID NO: 352 |
|---|---|---|
| 441/442 | G222S/A261V/A284T/G293R | + |
| 443/444 | L156W/A284T | + |
| 445/446 | A147G/G222S/L391V | + |
| 447/448 | A147G/L156W/A261V/V308S/A334S/K355T/E357T | + |
| 449/450 | L156E/G222S/A261I | + |
| 451/452 | L391V | + |
| 453/454 | G222S/G239V/A261I/L391V | + |
| 455/456 | G222S/L391V | + |
| 457/458 | A261V/L391V | + |
| 459/460 | G222S/A261V | + |
| 461/462 | A147G/L156W/A261V | + |
| 463/464 | A147G/L156W/A261V/L391V | + |
| 465/466 | A147G/A261V/L391V | + |
| 467/468 | A147G/G222S/A284T/L391V | + |
| 469/470 | A147G/L156W/A261I/L391V | + |
| 471/472 | A147G/L156W/G222S/A261V/A284T | + |
| 473/474 | G239V/A261V/A284T/L391V | + |
| 475/476 | L156W/G239V/A261I/L391V | + |
| 477/478 | A147G/L156W/G222S/A261V/A284T/L391V | + |
| 479/480 | L156W/A179G/A261V/A284T/L391V | + |
| 481/482 | A147G/A179G/A261V/L391V | + |
| 483/484 | L156E/G239V/L391V | + |
| 485/486 | A147G/L156W/G222S/A261I/A284T | + |
| 487/488 | A261V | + |

Levels of increased activity were determined relative to the reference polypeptide of SEQ ID NO: 352 and defined as follows: "+" 1.00 to 1.10, "++" >1.10

Example 11

Improved Phosphopentomutase Variants of SEQ ID NO: 418 for Production of Compound (1)

The engineered polynucleotide (SEQ ID NO: 417) encoding the polypeptide with phosphopentomutase activity of SEQ ID NO: 418 was used to generate the engineered polypeptides of Table 5.1. These polypeptides displayed improved phosphopentomutase activity under the desired conditions (e.g. ability to produce compound (3) as measured via the production of compound (1) in the presence of SP and engineered DERA and PNP enzymes, as shown in Scheme I), as compared to the starting polypeptide.

The engineered polypeptides, having the amino acid sequences of even-numbered sequence identifiers were generated from the "backbone" amino acid sequence of SEQ ID NO: 418, as described below. Directed evolution began with the polynucleotide set forth in SEQ ID NO: 417. Libraries of engineered polypeptides were generated using various well-known techniques (e.g., saturation mutagenesis, recombination of previously identified beneficial amino acid differences) and were screened using HTP assay and analysis methods that measured the polypeptides' phosphopentomutase activity. In this case, activity was measured via the production of compound (1) in the presence of SP and engineered DERA and PNP enzymes, as shown in Scheme I, using the analytical method in Table 13.1. The method provided herein finds use in analyzing the variants produced using the present invention. However, it is not intended that the methods described herein are the only methods applicable to the analysis of the variants provided herein and/or produced using the methods provided herein, as other suitable methods find use in the present invention.

High throughput lysates were prepared as follows. Frozen pellets from clonal PPM variants were prepared, as described in Example 1, and were lysed with 400 μl lysis buffer, as described in Example 2. The lysis mixture was shaken at room temperature for 2 hours. The plate was then centrifuged for 15 min at 4,000 rpm and 4° C.

Reactions were performed in a tandem 4-enzyme cascade setup involving DERA/PPM/PNP/SP enzymes in a 96-well format in 2 mL deep-well plates, with 100 μL total volume. Reactions included DERA, PNP, and SP as shake flask powders (0.5 wt % evolved DERA—DERA SEQ ID NO: 548, 0.5 wt % evolved PNP—PNP SEQ ID NO: 550, and 0.5 wt % evolved SP—SP SEQ ID NO: 552), 26 g/L or 124 mM of enantiopure (R)-2-ethynyl-glyceraldehyde substrate, 99 mM F-adenine (0.8 eq.), 186 mM acetaldehyde (40 wt % in isopropanol, 1.5 eq.), 372 mM sucrose (3.0 eq.), 5 mM $MnCl_2$, and 50 mM TEoA, pH 7.5. The reactions were set up as follows: (i) all the reaction components, except for PPM, were pre-mixed in a single solution, and 90 μL of this solution were then aliquoted into each well of the 96-well plates (ii) 10 μL of PPM lysate were then added into the wells to initiate the reaction. The reaction plate was heat-sealed and incubated at 35° C. with 600 rpm shaking for 18-20 hours.

The reactions were quenched with 300 μL 1:1 mixture of 1M KOH and DMSO. The quenched reactions were shaken for 10 min on a tabletop shaker followed by centrifugation at 4,000 rpm for 5 min at 4° C. to pellet any precipitate. Ten microliters of the supernatant were then transferred into a 96-well round bottom plate prefilled with 190 μL of 25% MeCN in 0.1 M TEoA, pH 7.5 buffer. The samples were injected onto a Thermo U3000 UPLC system and were separated using an Atlantis T3 C18, 3 μm, 2.1×100 mm column isocratically with a mobile phase containing 75:25 water:acetonitrile supplemented with 0.1% TFA, as described in Example 13, Table 13.1. Activity relative to SEQ ID NO: 418 was calculated as the peak area of compound (1) formed by the variant enzyme, compared to peak area of compound (1) formed by SEQ ID NO: 418, under the specified reaction conditions.

TABLE 11.1

| SEQ ID NO: (nt/aa) | Amino Acid Differences (Relative to SEQ ID NO: 418) | FIOP Relative to SEQ ID NO: 418 |
|---|---|---|
| 489/490 | Q155R | + |
| 491/492 | E121K | + |
| 493/494 | V255T | + |
| 495/496 | L120R | + |
| 497/498 | E121T | + |
| 499/500 | S100A | + |
| 501/502 | T241S | + |
| 503/504 | R267Q | + |
| 505/506 | A147G/E156L | + |
| 507/508 | V53L | + |
| 509/510 | T300S | + |
| 511/512 | D77E | + |
| 513/514 | E156W | + |
| 515/516 | K287R | + |
| 517/518 | F112M | + |
| 519/520 | F112R | + |
| 521/522 | T285M | + |
| 523/524 | H160S | + |
| 525/526 | L120V | + |
| 527/528 | F112N | + |

Levels of increased activity were determined relative to the reference polypeptide of SEQ ID NO: 418 and defined as follows: "+" 1.00 to 1.10

Example 12

Improved Phosphopentomutase Variants of SEQ ID NO: 412 for Production of Compound (1)

The engineered polynucleotide (SEQ ID NO: 411) encoding the polypeptide with phosphopentomutase activity of SEQ ID NO: 412 was used to generate the engineered polypeptides of Table 5.1. These polypeptides displayed improved phosphopentomutase activity under the desired conditions (e.g. ability to produce compound (3) as measured via the production of compound (1) in the presence of SP and engineered DERA and PNP enzymes as shown in Scheme I), as compared to the starting polypeptide.

The engineered polypeptides, having the amino acid sequences of even-numbered sequence identifiers were generated from the "backbone" amino acid sequence of SEQ ID NO: 412, as described below. Directed evolution began with the polynucleotide set forth in SEQ ID NO: 411. Libraries of engineered polypeptides were generated using various well-known techniques (e.g., saturation mutagenesis, recombination of previously identified beneficial amino acid differences) and were screened using HTP assay and analysis methods that measured the polypeptides' phosphopentomutase activity. In this case, activity was measured via the production of compound (1) in the presence of SP and engineered DERA and PNP enzymes, as shown in Scheme I, using the analytical method in Table 13.1. The method provided herein finds use in analyzing the variants produced using the present invention. However, it is not intended that the methods described herein are the only methods applicable to the analysis of the variants provided herein and/or produced using the methods provided herein, as other suitable methods find use in the present invention.

High throughput lysates were prepared as follows. Frozen pellets from clonal PPM variants were prepared, as described in Example 1, and were lysed with 400 μl lysis buffer, as described in Example 2. The lysis mixture was shaken at room temperature for 2 hours. The plate was then centrifuged for 15 min at 4,000 rpm and 4° C.

Reactions were performed in a tandem 4-enzyme cascade setup involving DERA/PPM/PNP/SP enzymes in a 96-well format in 2 mL deep-well plates, with 100 μL total volume. Reactions included DERA, PNP, and SP as shake flask powders (0.5 wt % evolved DERA—DERA SEQ ID NO: 548, 0.5 wt % evolved PNP—PNP SEQ ID NO: 550, and 0.5 wt % evolved SP—SP SEQ ID NO: 552), 26 g/L or 124 mM of enantiopure (R)-2-ethynyl-glyceraldehyde substrate, 99 mM F-adenine (0.8 eq.), 186 mM acetaldehyde (40 wt % in isopropanol, 1.5 eq.), 372 mM sucrose (3.0 eq.), 5 mM $MnCl_2$, and 50 mM TEoA, pH 7.5. The reactions were set up as follows: (i) all the reaction components, except for PPM, were pre-mixed in a single solution, and 90 μL of this solution were then aliquoted into each well of the 96-well plates (ii) 10 μL of PPM lysate were then added into the wells to initiate the reaction. The reaction plate was heat-sealed and incubated at 35° C. with 600 rpm shaking for 18-20 hours.

The reactions were quenched with 300 μL 1:1 mixture of 1M KOH and DMSO. The quenched reactions were shaken for 10 min on a tabletop shaker followed by centrifugation at 4,000 rpm for 5 min at 4° C. to pellet any precipitate. Ten microliters of the supernatant were then transferred into a 96-well round bottom plate prefilled with 190 μL of 25% MeCN in 0.1 M TEoA, pH 7.5 buffer. The samples were injected onto a Thermo U3000 UPLC system and were separated using an Atlantis T3 C18, 3 μm, 2.1×100 mm column isocratically with a mobile phase containing 75:25 water:acetonitrile supplemented with 0.1% TFA, as described in Example 13, Table 13.1. Activity relative to SEQ ID NO: 412 was calculated as the peak area of compound (1) formed by the variant enzyme, compared to peak area of compound (1) formed by SEQ ID NO: 412, under the specified reaction conditions.

TABLE 12.1

| SEQ ID NO: (nt/aa) | Amino Acid Differences (Relative to SEQ ID NO: 412) | FIOP Relative to SEQ ID NO: 412 |
|---|---|---|
| 529/530 | D77E/F112M/E121T/V255T | + |
| 531/532 | S100A/F112M/Q155R | + |
| 533/534 | F112M/L120R/E121T/T241S/V255T/T300S | + |
| 535/536 | E121T/V255T | + |
| 537/538 | F112R/E121T/V255T/K287R | + |
| 539/540 | F112M/L120R/E121T | + |
| 541/542 | V255T | + |
| 543/544 | S100A | + |
| 545/546 | F112M/E121T | + |

Levels of increased activity were determined relative to the reference polypeptide of SEQ ID NO: 412 and defined as follows: "+" 1.00 to 1.10

Example 13

Analytical Method

This Example provides the method used to collect the data provided in the above Examples. Data obtained as described in Examples 4-12 were collected using the analytical method in Table 13.1. The methods provided in this Example find use in analyzing the variants produced using the present invention. However, it is not intended that the present invention be limited to the methods described herein, as other suitable methods are known to those skilled in the art.

TABLE 13.1

| Analytical Method | |
|---|---|
| Instrument | ThermoScientific U3000 UPLC with UV Detection |
| Column | Atlantis T3 C18, 3 μm, 2.1 × 100 mm |
| Mobile Phase | Isocratic 75:25 water with 0.1% TFA:acetonitrile with 0.1% TFA |
| Flow Rate | 0.3 mL/min |
| Run Time | 1.6 min |
| Substrate and Product Elution order | F-adenine: 0.92 min<br>F-adenosine 1.12 min |
| Column Temperature | 40° C. |
| Injection Volume | 10 μL |
| Detection | UV 265 nm<br>Detector: Thermo VWD-3400; Peak width 0.02 min; Collection rate = 200 Hz; Time Constant = 0.12 s |

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (552 sequences)

SEQ ID NO: 1 - DNA, 1221 bp, Artificial Sequence
  WILD TYPE PHOSPHOPENTOMUTASE ENZYME
atgaaacgtgcatttattatggtgctggactcattcggcatcggcgctacagaagatgcagaacgctttggtgacgtcggggctgacaccctgggtcatatcgcagaagcttgtgccaaaggcgaagctgataacggtcgtaaaggcccgctcaatctgccaaatctgacccgtctggggctggcgaaagcacacgaaggttctaccggtttcattccggcgggaatggacggcaacgctgaagttatcggcgcgtacgcatgggcgcacgaaatgtcatccggtaaagataccccgtctggtcactgggaaattgccggtgtcccggttctgtttgagtggggatatttctccgatcacgaaaacagcttcccgcaagagctgctggataaactggtcgaacgcgctaatctgccgggttacctcggtaactgccactcttccggtacggtcattctggatcaactgggcgaagagcacatgaaaaccggcaagccgattttctatacctccgctgactccgtgttccagattgcctgccatgaagaaactttcggtctggataaactctacgaactgtgcgaaatcgcccgtgaagagctgaccaacggcggctacaatatcggtcgtgttatcgctcgtccgtttatcggcgacaaagccggtaacttccagcgtaccggtaaccgtcacgacctggctgttgagccgccagcaccgaccgtgctgcagaaactggttgatgaaaaacacggccaggtggtttctgtcggtaaaattgcggacatctacgccaactgcggtatcaccaaaaaagtgaaagcgactggcctggacgcgctgtttgacgccaccatcaaagagatgaaagaagcgggtgataacaccatcgtcttcaccaacttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaccggtactgaccacacgcgtgaacacattccggtactggtatatggcccgaaagtaaaaccgggctcactgggtcatcgtgaaaccttcgcggatatcggccagactctggcaaaatattttggtacttctgatatggaatatggcaaagccatgttc

SEQ ID NO: 2 - protein, 407 aa, Artificial Sequence
  WILD TYPE PHOSPHOPENTOMUTASE ENZYME
MKRAFIMVLDSFGIGATEDAERFGDVGADTLGHIAEACAKGEADNGRKGPLNLPNLTRLGLAKAHEGSTGFIPAGMDGNAEVIGAYAWAHEMSSGKDTPSGHWEIAGVPVLFEWGYFSDHENSFPQELLDKLVERANLPGYLGNCHSSGTVILDQLGEEHMKTGKPIFYTSADSVFQIACHEETFGLDKLYELCEIAREELTNGGYNIGRVIARPFIGDKAGNFQRTGNRHDLAVEPPAPTVLQKLVDEKHGQVVSVGKIADIYANCGITKKVKATGLDALFDATIKEMKEAGDNTIVFTNFVDFDSSWGHRRDVAGYAAGLELFDRRLPELMSLLRDDDILILTADHGCDPTWTGTDHTREHIPVLVYGPKVKPGSLGHRETFADIGQTLAKYFGTSDMEYGKAMF

SEQ ID NO: 3 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgttccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgccatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgcgggtaaaattgccgacatctacgccaaccgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaagggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 4 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLDKLYELCEIAREELTNGGYNIGRVIARPFIGDKAGNFQRTGNRRDLAIEPGGPTVLQKLVDEKHGQVVGAGKIADIYANRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 5 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgttccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggcctggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 6 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMALLRDDDILILTADHGCDPTWPGEDHTREHIPVLVYGPKVKPGSLGHRETFADIGQTLAKYFGTSDMEYGKAMF

SEQ ID NO: 7 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgttccggttctgtttgagatgggatattttaaggatctggaaaacagcttcccgcaagagctgctggataaactggtcgaacgcgctgggctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggacaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaagggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 8 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERAGLPGYLGNCRASGTTILDQLGEEHMKTGKPIFYTSEASVFQIACHEETFGLDKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 9 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggtgcgaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggaagggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 10 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGATGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 11 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 12 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 13 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgttccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgccatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggcctggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 14 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLDKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMSLLRDDDILILTADHGCDPTWPGEDHTREHIPVLVYGPKVKPGSLGHRETFADIGQTLAKYFGTSDMEYGKAMF

SEQ ID NO: 15 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 16 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 17 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggtgcgaccggtttcattccggcgggaatggacggcaacgctgaagttatcggcgcgtacgcatgggcgcacgaaatgtcatccggtaaagatagcctgtctggtcactgggaaattgccggtgttccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgccatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaagggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 18 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGATGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLDKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 19 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgccatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 20 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLDKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 21 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagtcatcggcgcgtacgcatgggcgcacgaaatgtcatccggtaaagatagcctgtctggtcactgggaaattgccggtgttccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgccatgaagaaactttcggtctggataagctctacgaactgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacatggccaggtggttggtgcgggtaaaattgccgacatctacgccaaccgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaagggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 22 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLDKLYELCEIAREELTNGGYNIGRVIARPFIGDKAGNFQRTGNRRDLAIEPGGPTVLQKLVDEKHGQVVGAGKIADIYANRGITKKVKATGLDALFDATIKEMKEAGDNTIVFTCFVDFDSLWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 23 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgcctgtcatgaagaaactttcggtctggacaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggcctggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 24 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLDKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMSLLRDDDILILTADHGCDPTWPGEDHTREHIPVLVYGPKVKPGSLGHRETFADIGQTLAKYFGTSDMEYGKAMF

SEQ ID NO: 25 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgttccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 26 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 27 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgttccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgccatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 28 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLDKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 29 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaaccaatcggcgcgtacgcatgggcgcacgaaatgtcatccggtaaagatagcctgtctggtcactgggaaattgccggtgttccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgccatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgcgggtaaaattgccgacatctacgccaaccgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaagggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 30 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEPIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLDKLYELCEIAREELTNGGYNIGRVIARPFIGDKAGNFQRTGNRRDLAIEPGGPTVLQKLVDEKHGQVVGAGKIADIYANRGITKKVKATGLDALFDATIKEMKEAGDNTIVFTCFVDFDSLWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 31 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaaccaatcggcgcgtacgcatgggcgcacgaactgtcatccggtaaagatagcctgtctggtcactgggaaattgccggtgttccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgccatgaagaaactttcggtctggataagctctacactctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacatggccaggtggttggtgcgggtaaaattgccgacatctacgccaaccgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaagggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 32 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEPIGAYAWAHELSSGKDSLSGHWEIAGVPVLFEMGYFKDLENSFPQELLDKLVERANLPGYLGNCRASGTTILDQLGEEHMKTGKPIFYTSEASVFQIACHEETFGLDKLYTLCEIAREELTNGGYNIGRVIARPFIGDKAGNFQRTGNRRDLAIEPGGPTVLQKLVDEKHGQVVGAGKIADIYANRGITKKVKATGLDALFDATIKEMKEAGDNTIVFTCFVDFDSLWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 33 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagtcatcggcgcgtacgcatgggcgcacgaaatgtcatccggtaaagatagcctgtctggtcactgggaaattgccggtgttccggttctgtttgagatgggatattttaaggatctggaaaacagcttcccgcaagagctgctggataaactggtcgaacgcgctaatctgccgggttacctcggtaactgccgtgcgtccggtacggagattctagatcagctgggcgaagagcacatgaaaaccggcaagccgattttctatacctccgaagcatccgtgttccagattgcctgccatgaagaaactttcggtctggataaactctacgagctgtgcgaaatcgcccgtgaagagctgaccaacggcggctacaatatcggtcgtgttatcgctcgtccgtttattggcgacaaagccggtaacttcaaacgtactggtaaccgtcgtgacctggctattgagccgggggggccgaccgtgctgcagaaactggttgatgaaaaaggtggccaggtggtttctgtcggtaaaattgccgacatctacgccaaccgcggtatcaccaaaaaagtgaaagcgactggcctggacgcgctgtttgacgccaccatcgaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaccggtactgaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 34 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTEILDQLGEEHMKTGKPIFYTSEASVFQIACHEETFGLDKLYELCEIAREELTNGGYNIGRVIARPFIGDKAGNFKRTGNRRDLAIEPGGPTVLQKLVDEKGGQVVSVGKIADIYANRGITKKVKATGLDALFDATIEEMKEAGDNTIVFTCFVDFDSSWGHRRDVAGYAAGLELFDRRLPELMSLLRDDDILILTADHGCDPTWTGTDHTREHIPVLVYGPKVKPGSLGHRETFADIGQTVAKYFGTSDMEYGKAMF

SEQ ID NO: 35 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgtttaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 36 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLFKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 37 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctactctgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 38 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYSGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 39 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtgttacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 40 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGVTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 41 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctcaggagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 42 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAQEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 43 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctaaggagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 44 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAKEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 45 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggtgccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 46 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGVPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 47 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccggggtcgccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 48 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGSPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 49 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttcgggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 50 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFRDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 51 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggcgccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 52 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGAPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 53 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggtcgggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 54 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGSGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 55 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatttgctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 56 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDLLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 57 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctgggtgggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 58 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWVGEDHTREHIPVLVYGPKVKPGSLGHRETFADIGQTLAKYFGTSDMEYGKAMF

SEQ ID NO: 59 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaagcgtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 60 - protein, 407 aa, Artificial Sequence
  ENGINEERED PHOSPHOPENTOMUTASE VARIANT ENZYMES
MKRAFIMTMDSFGIGATEDAEAFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 61 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgagcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 62 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAERGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 63 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacttgtacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 64 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADLYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 65 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgacggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 66 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPTGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 67 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgagtgggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 68 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPSGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 69 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggacgggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 70 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGTGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 71 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactcatggagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 72 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLMELCEIAREELTNGGYNIGRVIARPFIGDKAGNFQRTGNRRDLAIEPGGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 73 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgcaggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 74 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPQGPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 75 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccggggttggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 76 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGVGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 77 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacacgaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 78 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGRGITKKVKATGLDALFDTTIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 79 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttgctgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 80 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVAVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 81 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccggggcggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 82 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGRPTVLQKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 83 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgtctaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 84 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLSKLVDEKHGQVVGVGKIADIYAGRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 85 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 86 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 87 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagcaggtaacttccaacgtactggtaaccgtcgtgacctggctattgagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgttaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacctgctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 88 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYAGRGITKKVKATGLDALFDVTIKEMKEAGDNTIVFTCFVDFDSSWGHRRDVAGYAAGLELFDRRLPELMSLLRDDDLLILTADHGCDPTWKGEDHTREHIPVLVYGPKVKPGSLGHRETFADIGQTLAKYFGTSDMEYGKAMF

SEQ ID NO: 89 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 90 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 91 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgctcatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccggggggtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 92 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 93 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatctgctgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccggggggtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 94 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDLLGEEHMKTGKPIFYTSEASVFQIAAHEETFGLEKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 95 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtgtgacgattctagatcagctgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggctccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 96 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGVTILDQLGEEHMKTGKPIFYTSEASVFQIAAHEETFGLEKLYELCEIAREELTNGGYNIGRVIARPFIGDKAGNFQRTGNRRDLAQEPGAPTVLQKLVDEKHGQVVGVGKIADIYANRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 97 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtgtgacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggctccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctagctggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 98 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGVTILDQLGEEHMKTGKPIFYTSEASVFQIAAHEETFGLDKLYELCEIAREELTNGGYNIGRVIARPFIGDKAGNFQRTGNRRDLAQEPGAPTVLQKLVDEKHGQVVGVGKIADIYANRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 99 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaaccgatcggcgcgtacgcatgggcgcacgaaatgtcatccggtaaagatagcctgtctggtcactgggaaattgccggtgtcccggttctgtttgagatgggatattttaaagatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgaccgggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 100 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEPIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPTGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 101 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctatcgagccggggggtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 102 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 103 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggctccgaccgtgctgttcaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 104 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAQEPGAPTVLFKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 105 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagtcatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgaccgggccgaccgtgctgcagaaactggttgatgaaaaacacggccaggtggttgccgtcggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 106 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPTGPTVLQKLVDEKHGQVVAVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 107 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctatcgagccggggagtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 108 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPGSPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 109 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgctcatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccggggagtccgaccgtgctgcaaaaactggttgatgaaaaacacggccaggtggttggtgtgggtaaaattgccgacatctacgcgaaccgcggtatcaccaaaaaagtgaaagcgactggcctggacgcgctgtttgacgccaccatcaaagagatgaaagaagcgggtgataacaccatcgtcttcacctgcttcgttgacttcgactctagctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 110 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAQEPGSPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 111 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctatcgagccggggagtccgaccgtgctgcaaaaactggttgatgaaaaacacggccaggtggttggtgtgggtaaaattgccgacatctacgcggagcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 112 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAIEPGSPTVLQKLVDEKHGQVVGVGKIADIYAERGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 113 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctatcgagccggggagtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 114 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAIEPGSPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 115 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 116 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 117 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatctgctgggcgaagagcacatgaaaaccggcaagccgattttctatacctccgaagcatccgtgttccagattgccgctcatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccggggagtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 118 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDLLGEEHMKTGKPIFYTSEASVFQIAAHEETFGLEKLYELCEIAREELTNGGYNIGRVIARPFIGDKAGNFQRTGNRRDLAQEPGSPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 119 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtgtgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccggggagtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 120 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGVTILDQLGEEHMKTGKPIFYTSEASVFQIAAHEETFGLEKLYELCEIAREELTNGGYNIGRVIARPFIGDKAGNFQRTGNRRDLAQEPGSPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 121 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 122 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 123 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtgtgacgattctagatctgctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggctccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 124 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGVTILDLLGEEHMKTGKPIFYTSEASVFQIACHEETFGLEKLYELCEIAREELTNGGYNIGRVIARPFIGDKAGNFQRTGNRRDLAIEPGAPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 125 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgcctgtcatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccggggggtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctagctggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 126 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLEKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 127 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtgtgacgattctagatctgctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccggggggtccgaccgtgctgcaaaaactggttgatgaaaaacacggccaggtggttggtgtgggtaaaattgccgacatctacgcgaaccgcggtatcaccaaaaaagtgaaagcgactggcctggacgcgctgtttgacgccaccatcaaagagatgaaagaagcgggtgataacaccatcgtcttcacctgcttcgttgacttcgactctagctggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 128 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGVTILDLLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 129 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagtcatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgaccgggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 130 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPTGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 131 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctatcgagccggggagtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 132 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPGSPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 133 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgcctgtcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctatcgagccggggagtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 134 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIACHEETFGLDKLYELCEIAREELTNGGYNIGRVIARPFIGDKAGNFQRTGNRRDLAIEPGSPTVLQKLVDEKHGQVVGVGKIADIYANRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 135 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatctgctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccggggagtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 136 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDLLGEEHMKTGKPIFYTSEASVFQIAAHEETFGLDKLYELCEIAREELTNGGYNIGRVIARPFIGDKAGNFQRTGNRRDLAQEPGSPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 137 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgagtgggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 138 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPSGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 139 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaaccgatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggtgggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgcgaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 140 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEPIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 141 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagtcatcggcgcgtacgcatgggcgcacgaaatgtcatccggtaaagatagcctgtctggtcactgggaaattgccggtgtcccggttctgtttgagatgggatattttaaagatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgaccgggccgaccgtgctgcagaaactggttgatgaaaaacacggccaggtggttggtgtgggtaaaattgccgacatttacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 142 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPTGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 143 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaagatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgagtgggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcaccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 144 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPSGPTVLQKLVDEKHGQVVGVGKIADIYANRGITKKVKATGLDALFDATIKEMKEAGDNTIVFTCFVDFDSSWGHRRDVTGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 145 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagtcatcggcgcgtacgcatgggcgcacgaaatgtcatccggtaaagatagcctgtctggtcactgggaaattgccggtgtcccggttctgtttgagatgggatattttaaagatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactcatggagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgagtgggccgaccgtgctgcagaaactggttgatgaaaaacacggccaggtggttgccgtcggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 146 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLMELCEIAREELTNGGYNIGRVIARPFIGDKAGNFQRTGNRRDLAIEPSGPTVLQKLVDEKHGQVVAVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 147 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtgtgacgattctagatcagctgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 148 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGVTILDQLGEEHMKTGKPIFYTSEASVFQIAAHEETFGLEKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 149 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaaccgatcggcgcgtacgcatgggcgcacgaaatgtcatccggtaaagatagcctgtctggtcactgggaaattgccggtgtcccggttctgtttgagatgggatattttcgtgatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactcatggagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggtgggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 150 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEPIGAYAWAHEMSSGKDSLSGHWEIAGVPVLFEMGYFRDLENSFPQELLDKLVERANLPGYLGNCRASGTTILDQLGEEHMKTGKPIFYTSEASVFQIAAHEETFGLEKLMELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 151 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaaccgatcggcgcgtacgcatgggcgcacgaaatgtcatccggtaaagatagcctgtctggtcactgggaaattgccggtgtcccggttctgtttgagatgggatattttaaagatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgaccgggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 152 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEPIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPTGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 153 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccggggagtccgaccgtgctgttcaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctagctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 154 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAQEPGSPTVLFKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 155 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagtcatcggcgcgtacgcatgggcgcacgaaatgtcatccggtaaagatagcctgtctggtcactgggaaattgccggtgtcccggttctgtttgagatgggatattttcgtgatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactcatggagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggtgggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 156 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFRDLENSFPQELLDKLVERANLPGYLGNCRASGTTILDQLGEEHMKTGKPIFYTSEASVFQIAAHEETFGLEKLMELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 157 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaaccgatcggcgcgtacgcatgggcgcacgaaatgtcatccggtaaagatagcctgtctggtcactgggaaattgccggtgtcccggttctgtttgagatgggatattttcgtgatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgaccgggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgcgaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 158 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEPIGAYAWAHEMSSGKDSLSGHWEIAGVPVLFEMGYFRDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPTGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 159 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaaccgatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgagtgggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 160 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEPIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPSGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 161 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtgtgacgattctagatctgctgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccggggagtccgaccgtgctgcaaaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 162 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGVTILDLLGEEHMKTGKPIFYTSEASVFQIAAHEETFGLEKLYELCEIAREELTNGGYNIGRVIARPFIGDKAGNFQRTGNRRDLAQEPGSPTVLQKLVDEKHGQVVGVGKIADIYANRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 163 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctatcgagccgggggctccgaccgtgctgcaaaaactggttgatgaaaaacacggccaggtggttggtgtgggtaaaattgccgacatctactcgaaccgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 164 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAIEPGAPTVLQKLVDEKHGQVVGVGKIADIYSNRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 165 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 166 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 167 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctagctggggccaccgtcgcgacgtcgccggttatgccgcgggtctggaactgttcgaccgccgtctgccggagctgatgtcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 168 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMSLLRDDDILILTADHGCDPTWKGEDHTREHIPVLVYGPKVKPGSLGHRETFADIGQTLAKYFGTSDMEYGKAMF

SEQ ID NO: 169 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatctgctgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccggggagtccgaccgtgctgttcaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 170 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDLLGEEHMKTGKPIFYTSEASVFQIAAHEETFGLEKLYELCEIAREELTNGGYNIGRVIARPFIGDKAGNFQRTGNRRDLAQEPGSPTVLFKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 171 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtgtgacgattctagatcagctgggcgaagagcacatgaaaaccggcaagccgattttctatacctccgaagcatcagtgttccagattgcctgtcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctacgcgaaccgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 172 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGVTILDQLGEEHMKTGKPIFYTSEASVFQIACHEETFGLDKLYELCEIAREELTNGGYNIGRVIARPFIGDKAGNFQRTGNRRDLAIEPGGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 173 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaacgctttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagtcatcggcgcgtacgcatgggcgcacgaaatgtcatccggtaaagatagcctgtctggtcactgggaaattgccggtgtcccggttctgtttgagatgggatattttcgtgatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttgccgtcggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 174 - protein, 407 aa, Artificial Sequence
  ENGINEERED PHOSPHOPENTOMUTASE VARIANT ENZYMES
MKRAFIMTMDSFGIGATEDAERFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFRDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPGGPTVLQKLVDEKHGQVVAVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 175 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttcgtgatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgaccgggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgcgaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 176 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFRDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPTGPTVLQKLVDEKHGQVVGVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 177 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaaccgatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgcaggggccgaccgtgctgcagaaactggttgatgaaaaacacggccaggtggttgccgtcggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactcttcctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 178 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEPIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPQGPTVLQKLVDEKHGQVVAVGKIADIYANRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 179 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtacgacgattctagatcaactgggcgaagagcacatgaaaaccggcaagccgattttctatacctccgaagcatccgtgttccagattgccgcccatgaagaaactttcggtctggaaaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctattgagccgggggggccgaccgtgctgcagaaactggttgatgaaaaacacggccaggtggttggtgtgggtaaaattgccgacatctactcgaaccgcggtatcaccaaaaaagtgaaagcgactggcctggacgcgctgtttgacgccaccatcaaagagatgaaagaagcgggtgataacaccatcgtcttcacctgcttcgttgacttcgactctagctggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 180 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLEKLYELCEIAREELTNGGYNIGRVIARPFIGDKAGNFQRTGNRRDLAIEPGGPTVLQKLVDEKHGQVVGVGKIADIYSNRGITKKVKATGLDALFDATIKEMKEAGDNTIVFTCFVDFDSSWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 181 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttcttgatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 182 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFLDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 183 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtattgggcccgaaagtaaaaccgggctcactgggtcatcgtgaaaccttcgcggatatcggccagactctggcaaaatattttggtacctctgatatggaatatggcaaagccatgttc

SEQ ID NO: 184 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVLGPKVKPGSLGHRETFADIGQTLAKYFGTSDMEYGKAMF

SEQ ID NO: 185 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatctgtgagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 186 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATICEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 187 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaaaagatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 188 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEKIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 189 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttcgtgcgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 190 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFVRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 191 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatgaggggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 192 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMRGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 193 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatccttgagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 194 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATILEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 195 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaattgtttggtacctctgatatggaatatggcaaagccatgttc

SEQ ID NO: 196 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKLFGTSDMEYGKAMF

SEQ ID NO: 197 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 198 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 199 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagatatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 200 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEDIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 201 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 202 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 203 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgctgcaaaatattttggtacctctgatatggaatatggcaaagccatgttc

SEQ ID NO: 204 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTAAKYFGTSDMEYGKAMF

SEQ ID NO: 205 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaaaaggctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 206 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVEKANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 207 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatgcagggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 208 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMQGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 209 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagattatctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 210 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDYLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 211 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatactccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 212 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNTPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 213 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctgctgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 214 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAAEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 215 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatggggcccgaaagtaaaaccgggctcactgggtcatcgtgaaaccttcgcggatatcggccagactctggcaaaatattttggtacctctgatatggaatatggcaaagccatgttc

SEQ ID NO: 216 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVWGPKVKPGSLGHRETFADIGQTLAKYFGTSDMEYGKAMF

SEQ ID NO: 217 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatgtggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 218 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDVENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 219 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggttgttctgatatggaatatggcaaagccatgttc

SEQ ID NO: 220 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGCSDMEYGKAMF

SEQ ID NO: 221 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaataagggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 222 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANKGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 223 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacggggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 224 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKRGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 225 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcagggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 226 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANQGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 227 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatcgggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 228 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDRENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 229 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctggggaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 230 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAGEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 231 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatatgctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 232 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDMLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 233 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtatggaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 234 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGMDHTREHIPVLVYGPKVKPGSLGHRETFADIGQTLAKYFGTSDMEYGKAMF

SEQ ID NO: 235 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatgttctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 236 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDVLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 237 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgcggcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 238 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSAASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 239 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagcctcgaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 240 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 241 - DNA, 1221 bp, Artificial Sequence
  ENGINEERED PHOSPHOPENTOMUTASE VARIANT ENZYMES
atgaaacgtgcatttattatgacgatggactcattcggcatcggctctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 242 - protein, 407 aa, Artificial Sequence
  ENGINEERED PHOSPHOPENTOMUTASE VARIANT ENZYMES
MKRAFIMTMDSFGIGSTEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 243 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaaacgggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 244 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKTGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 245 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcagtgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 246 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLSVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 247 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactcattgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 248 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLIELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 249 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtagttggcccgaaagtaaaaccgggctcactgggtcatcgtgaaaccttcgcggatatcggccagactctggcaaaatattttggtacctctgatatggaatatggcaaagccatgttc

SEQ ID NO: 250 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVVGPKVKPGSLGHRETFADIGQTLAKYFGTSDMEYGKAMF

SEQ ID NO: 251 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaatctggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 252 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKSGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 253 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatgatctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 254 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDDLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 255 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcgtggtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 256 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLVVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 257 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgctccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 258 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNAPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 259 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaaggtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 260 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLKVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 261 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttattgatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 262 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFIDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 263 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctggctaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 264 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLAKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 265 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggattcgctctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 266 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDSLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 267 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaatgtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 268 - protein, 407 aa, Artificial Sequence
  ENGINEERED PHOSPHOPENTOMUTASE VARIANT ENZYMES
MKRAFIMTMDSFGIGATEDAEMFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 269 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcggctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 270 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDRLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 271 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactgacggaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 272 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLTERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 273 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtatttctgatatggaatatggcaaagccatgttc

SEQ ID NO: 274 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGISDMEYGKAMF

SEQ ID NO: 275 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcggggagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 276 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIGEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 277 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatgtgtctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 278 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMCLLRDDDILILTADHGCDPTWKGEDHTREHIPVLVYGPKVKPGSLGHRETFADIGQTLAKYFGTSDMEYGKAMF

SEQ ID NO: 279 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggagggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 280 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMEGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 281 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatcctgaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 282 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDPENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 283 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaattggctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 284 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVELANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 285 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcgaggtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 286 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLEVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 287 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcaattaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 288 - protein, 407 aa, Artificial Sequence
  ENGINEERED PHOSPHOPENTOMUTASE VARIANT ENZYMES
MKRAFIMTMDSFGIGATEDAIKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 289 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcaggtgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 290 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQVGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 291 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacgttgccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 292 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDVAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 293 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggctggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 294 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMAGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 295 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggcgaaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 296 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLAKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 297 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgggccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 298 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNGPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 299 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtgtgtctgatatggaatatggcaaagccatgttc

SEQ ID NO: 300 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGVSDMEYGKAMF

SEQ ID NO: 301 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattggtgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 302 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIGDIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 303 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtctttctgatatggaatatggcaaagccatgttc

SEQ ID NO: 304 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGLSDMEYGKAMF

SEQ ID NO: 305 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactgttggaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 306 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLLERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 307 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaagtgggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 308 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKVGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 309 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgaagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 310 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLKKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 311 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgaccgtgccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 312 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDRAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 313 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatgagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 314 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDELGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 315 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtgagtctgatatggaatatggcaaagccatgttc

SEQ ID NO: 316 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGESDMEYGKAMF

SEQ ID NO: 317 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaaccgccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 318 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQPPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 319 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaatatggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 320 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKYGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 321 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgccgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaacatggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 322 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKHGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 323 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatgacgggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 324 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMTGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 325 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacactaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 326 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDTTIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 327 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtgattctgatatggaatatggcaaagccatgttc

SEQ ID NO: 328 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGDSDMEYGKAMF

SEQ ID NO: 329 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcacagaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 330 - protein, 407 aa, Artificial Sequence
  ENGINEERED PHOSPHOPENTOMUTASE VARIANT ENZYMES
MKRAFIMTMDSFGIGATEDAQKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 331 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagcccttaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 332 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKALNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 333 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagagggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 334 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKEGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 335 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcaggagggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 336 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 337 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtttgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 338 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGLGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 339 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagcgatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 340 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEAIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 341 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagagaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgacgggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 342 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 343 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcatggaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcgacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 344 - protein, 407 aa, Artificial Sequence
  ENGINEERED PHOSPHOPENTOMUTASE VARIANT ENZYMES
MKRAFIMTMDSFGIGATEDAWKFGDVGADTLGHIAEACAKGEADNGRKGPLNVPNLTRLGLAKAHEGSTGFIPAGMDGDAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 345 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagagaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgcgggccgcggtatcaccaaaaaagtgaaagcgtcgggcctggacgcgctgtttgacgccaccatcgttgagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 346 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYAGRGITKKVKASGLDALFDATIVEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 347 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattattgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 348 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 349 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgtggacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 350 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIVDIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 351 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 352 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 353 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcatggaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgtcgggcctggacgcgctgtttgacgccaccatcaaggagatgaaagaagcgggtgataacaccatcgtcttcaccaacttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 354 - protein, 407 aa, Artificial Sequence
  ENGINEERED PHOSPHOPENTOMUTASE VARIANT ENZYMES
MKRAFIMTMDSFGIGATEDAWKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKASGLDALFDATIKEMKEAGDNTIVFTNFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 355 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 356 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 357 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattggggctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 358 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIGAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 359 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggttccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 360 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 361 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggtgccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 362 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGVPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 363 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggactggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 364 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWTGEDHTREHIPVLVYGPKVKPGSLGHRETFADIGQTLAKYFGTSDMEYGKAMF

SEQ ID NO: 365 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaggtgtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 366 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKGVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 367 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattggaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 368 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYWKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 369 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtagtacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 370 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGSTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 371 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcaccaatttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 372 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTNFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 373 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcaccaatttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 374 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTNFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 375 - DNA, 1221 bp, Artificial Sequence; identical to SEQ ID NO: 89
  ENGINEERED PHOSPHOPENTOMUTASE VARIANT ENZYMES

SEQ ID NO: 376 - protein, 407 aa, Artificial Sequence; identical to SEQ ID NO: 90
  ENGINEERED PHOSPHOPENTOMUTASE VARIANT ENZYMES

SEQ ID NO: 377 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtacttcgaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 378 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTSNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 379 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 380 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 381 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgtcgggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 382 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKASGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 383 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttgtgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 384 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVVFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 385 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcaggtacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 386 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGRYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 387 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatgcggtatggcaaagccatgttc

SEQ ID NO: 388 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMRYGKAMF

SEQ ID NO: 389 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcattgggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 390 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSLGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 391 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgaccagggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 392 - protein, 407 aa, Artificial Sequence
  ENGINEERED PHOSPHOPENTOMUTASE VARIANT ENZYMES
MKRAFIMTMDSFGIGATEDAEKFGDQGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 393 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttcgttttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 394 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVRFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 395 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcatggaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 396 - protein, 407 aa, Artificial Sequence
  ENGINEERED PHOSPHOPENTOMUTASE VARIANT ENZYMES
MKRAFIMTMDSFGIGATEDAWKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 397 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtacggccgggctcactgggtcatcgtgaaaccttcgcggatatcggccagactctggcaaaatattttggtacctctgatatggaatatggcaaagccatgttc

SEQ ID NO: 398 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVRPGSLGHRETFADIGQTLAKYFGTSDMEYGKAMF

SEQ ID NO: 399 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactgcgaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 400 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTANRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 401 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgagggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 402 - protein, 407 aa, Artificial Sequence
  ENGINEERED PHOSPHOPENTOMUTASE VARIANT ENZYMES
MKRAFIMTMDSFGIGATEDAEKFGDEGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 403 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcaaagagatgaaagaagcgcgtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 404 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIKEMKEARDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 405 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccaatcgcggtatcaccaaaaaagtgaaagcgactggcctggacgcgctgtttgacgccaccatcgtagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 406 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYANRGITKKVKATGLDALFDATIVEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 407 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacgccgggcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 408 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYAGRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 409 - DNA, 1221 bp, Artificial Sequence
  ENGINEERED PHOSPHOPENTOMUTASE VARIANT ENZYMES
atgaaacgtgcatttattatgacgatggactcattcggcatcggcgctacagaagatgcagaaaagtttggtgacgtcggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcatccggtaaagatagcctgtctggtcactgggaaattgccggtgtcccggttctgtttgagcagggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggctacaatatcggtcgtgttatcgctcgtccgtttatcggcgacaaagccggtaacttccaacgtactggtaaccgtcgtgacctggctcaagagccgggggggccgaccgtgctgcagaaactggttgatgaaaaacacggccaggtggttggtgtgggtaaaattgccgacatctacagcaatcgcggtatcaccaaaaaagtgaaagcgactggcctggacgcgctgtttgacgccaccatcaaagagatgaaagaagcgggtgataacaccatcgtcttcacctgcttcgttgacttcgactctctgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 410 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEQGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYSNRGITKKVKATGLDALFDATIKEMKEAGDNTIVFTCFVDFDSLWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 411 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 412 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 413 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccggggggcccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 414 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 415 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccggggggcccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 416 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIVDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 417 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 418 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 419 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagctgggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccggggggcccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 420 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 421 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccggggggcccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 422 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 423 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagtggggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccggggggcccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 424 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQWGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIVDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 425 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagtggggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccggggggcccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 426 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIVDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 427 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccggggggcccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 428 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQWGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIADIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 429 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 430 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIVDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 431 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 432 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 433 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 434 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 435 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccggggggcccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 436 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 437 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 438 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 439 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 440 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 441 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagctgggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccggggggcccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacaccaccatcaaagagatgaaagaagcgcgtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 442 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIVDIYAGRGITKKVKATGLDALFDTTIKEMKEARDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 443 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 444 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 445 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccgggggggccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 446 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQLGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIADIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 447 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccggggggcccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactcttcctggggccaccgtcgcgacgtcgccggttatgccgcgggtctggaactgttcgaccgccgtctgccggagctgatgtctctgctgcgcgatgacgacatcctgatcctcaccgctgaccacggttgcgatccgacctggaccggtactgaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 448 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIVDIYAGRGITKKVKATGLDALFDATIKEMKEAGDNTIVFTCFVDFDSSWGHRRDVAGYAAGLELFDRRLPELMSLLRDDDILILTADHGCDPTWTGTDHTREHIPVLVYGPKVKPGSLGHRETFADIGQTLAKYFGTSDMEYGKAMF

SEQ ID NO: 449 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccggggggcccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 450 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIIDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 451 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccggggggcccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 452 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIADIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 453 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccgggggtcccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 454 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKASNFQRTGNRRDLAQEPGVPTVLQKLVDEKHGQVVGVGKIIDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 455 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccggggggcccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 456 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIADIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 457 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 458 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIVDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 459 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagctgggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccggggggcccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 460 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIVDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 461 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccggggggcccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 462 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIVDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 463 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccggggggcccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 464 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIVDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 465 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccggggggcccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 466 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIVDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 467 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagctgggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccgggggggccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 468 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQLGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIADIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 469 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacgccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 470 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 471 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccgggggggccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 472 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQWGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIVDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 473 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggtcccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 474 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGVPTVLQKLVDEKHGQVVGVGKIVDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 475 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggtcccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 476 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGVPTVLQKLVDEKHGQVVGVGKIIDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 477 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccgggggggccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 478 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQWGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIVDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 479 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattggggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 480 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQWGEEHMKTGKPIFYTSEASVFQIGAHEETFGLDKLYELCEIAREELTNGGYNIGRVIARPFIGDKAGNFQRTGNRRDLAQEPGGPTVLQKLVDEKHGQVVGVGKIVDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 481 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagctgggcgaagagcacatgaaaaccggcaagccgattttctatacctccgaagcatccgtgttccagattggggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 482 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQLGEEHMKTGKPIFYTSEASVFQIGAHEETFGLDKLYELCEIAREELTNGGYNIGRVIARPFIGDKAGNFQRTGNRRDLAQEPGGPTVLQKLVDEKHGQVVGVGKIVDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 483 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggtcccgaccgtgctgcagaaactggttgatgaaaaacacggccaggtggttggtgtgggtaaaattgccgacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 484 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGVPTVLQKLVDEKHGQVVGVGKIADIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 485 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagtggggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccagtaacttccaacgtactgggaaccgtcgtgacctggctcaagagccggggggcccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 486 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQWGEEHMKTGKPIFYTSEASVFQIAAHEETFGLDKLYELCEIAREELTNGGYNIGRVIARPFIGDKASNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 487 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcgtccggtactacgattctagatcagctgggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattgtggacatctacgcgggccgcggtatcaccaaaaaagtgaaagcgactggcctggacgcgctgtttgacgccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 488 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIVDIYAGRGITKKVKATGLDALFDATIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 489 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcgtgagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 490 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDREGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 491 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctgaagaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 492 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLKNSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 493 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtgacgggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 494 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVTGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 495 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatagggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 496 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDRENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 497 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctgacgaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 498 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLTNSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 499 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctggcgggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 500 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLAGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 501 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgtcggtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 502 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPSVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 503 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccagggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 504 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGQGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 505 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtggctccggtactacgattctagatcagttgggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 506 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRGSGTTILDQLGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 507 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatttgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 508 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNLPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 509 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcagttgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 510 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFSCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 511 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggagggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 512 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMEGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 513 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 514 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 515 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcagggagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 516 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIREMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 517 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgatggagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 518 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLMEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 519 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgagggagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 520 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLREMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 521 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccatgatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 522 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTMIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 523 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcaggagggcgaagagtcgatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 524 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQEGEESMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 525 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgtttgagatgggatattttaaggatgttgaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 526 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDVENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 527 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgaatgagatgggatattttaaggatctggaaaacagcttcccgcaagagctgctggataaactggtcgaacgcgctaatctgccgggttacctcggtaactgccgtgcctccggtactacgattctagatcaggagggcgaagagcacatgaaaaccggcaagccgattttctatacctccgaagcatccgtgttccagattgcggctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgtttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactgtggcaaaatattttggtacctctgatatggaatatggcaaagccatgttc

SEQ ID NO: 528 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLNEMGYFKDLENSFPQELLDKLVERANLPGYLGNCRASGTTILDQEGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTVAKYFGTSDMEYGKAMF

SEQ ID NO: 529 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggagggcaacgctgaagttatcggcgcgtacgcatgggcgcacgaaatgtcaagtggtaaagatagcctgtctggtcactgggaaattgccggtgtcccggttctgatggagatgggatattttaaggatctgactaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtgacgggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 530 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMEGNAEVIGAYAWAHEMSSGKDSLSGHWEIAGVPVLMEMGYFKDLTNSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVTGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 531 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggatggcaacgctgaagttatcggcgcgtacgcatgggcgcacgaaatgtcaagtggtaaagatagcctggcgggtcactgggaaattgccggtgtcccggttctgatggagatgggatattttaaggatctggaaaacagcttcccgcaagagctgctggataaactggtcgaacgcgctaatctgccgggttacctcggtaactgccgtgcctccggtactacgattctagatcgttggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccacgatcaaagagatgaaagaagcgggtgataacaccatcgtcttcacgtgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 532 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLAGHWEIAGVPVLMEMGYFKDLENSFPQELLDKLVERANLPGYLGNCRASGTTILDRWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 533 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggatggcaacgctgaagttatcggcgcgtacgcatgggcgcacgaaatgtcaagtggtaaagatagcctgtctggtcactgggaaattgccggtgtcccggttctgatggagatgggatattttaaggatcgtactaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgagcgtgctgcagaaactggttgatgaaaaacacggccaggtgacgggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttctcgtgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 534 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLMEMGYFKDRTNSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPSVLQKLVDEKHGQVTGVGKIIDIYAGRGITKKVKATGLDALFDTTIKEMKEAGDNTIVFSCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 535 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggatggcaacgctgaagttatcggcgcgtacgcatgggcgcacgaaatgtcaagtggtaaagatagcctgtctggtcactgggaaattgccggtgtcccggttctgtttgagatgggatattttaaggatctgactaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtgacgggtgtgggtaaaattatcgacatctacgcgggccgcggtatcaccaaaaaagtgaaagcgactggcctggacgcgctgtttgacaccacgatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 536 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLTNSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVTGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 537 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgcgcgagatgggatattttaaggatctgactaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtgacgggtgtgggtaaaattatcgacatctacgcgggccgcggtatcaccaaaaaagtgaaagcgactggcctggacgcgctgtttgacaccacgatccgtgagatgaaagaagcgggtgataacaccatcgtcttcacgtgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 538 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLREMGYFKDLTNSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVTGVGKIIDIYAGRGITKKVKATGLDALFDTTIREMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 539 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtctggtcactgggaaattgccggtgtcccggttctgatggagatgggatattttaaggatcgtactaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgtggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 540 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLMEMGYFKDRTNSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 541 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggatggcaacgctgaagttatcggcgcgtacgcatgggcgcacgaaatgtcaagtggtaaagatagcctgtctggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtgacgggtgtgggtaaaattatcgacatctacgcgggccgtggtatcaccaaaaaagtgaaagcgactggcctggacgcgctgtttgacaccaccatcaaagagatgaaagaagcgggtgataacaccatcgtcttcacgtgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 542 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLFEMGYFKDLENSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVTGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 543 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctggcgggtcactgggaaattgccggtgtcccggttctgtttgagatgggatattttaaggatctggaaaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 544 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLAGHWEIAGVPVLFEMGYFKDLENSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 545 - DNA, 1221 bp, Artificial Sequence
  ENGINEERED PHOSPHOPENTOMUTASE VARIANT ENZYMES
atgaaacgtgcatttattatgacgatggactcattcggcatcggtgctacagaagatgcagaaaagtttggtgacgtaggggctgacaccctgggtcatatcgcagaagcttgtgccaaaggcgaagctgataacggtcgtaaaggcccgctcaatgtgccaaatctgacccgtctggggctggcgaaagctcacgaaggttctaccggtttcattccggcgggaatggacggcaacgctgaagttatcggcgcgtacgcatgggcgcacgaaatgtcaagtggtaaagatagcctgtcgggtcactgggaaattgccggtgtcccggttctgatggagatgggatattttaaggatctgactaacagcttcccgcaagagctgctggataaactggtcgaacgcgctaatctgccgggttacctcggtaactgccgtgcctccggtactacgattctagatcagtggggcgaagagcacatgaaaaccggcaagccgattttctatacctccgaagcatccgtgttccagattgccgctcatgaagaaactttcggtctggataaactctacgagctgtgcgaaatcgcccgtgaagagctgaccaacggcggttacaatatcggtcgtgttatcgctcgtccgtttatcggcgacaaagccggtaacttccaacgtactgggaaccgtcgtgacctggctcaagagccgggggggccgaccgtgctgcagaaactggttgatgaaaaacacggccaggtggttggtgtgggtaaaattatcgacatctacgcgggccgcggtatcaccaaaaaagtgaaagcgactggcctggacgcgctgtttgacaccaccatcaaagagatgaaagaagcgggtgataacaccatcgtcttcacctgcttcgttgacttcgactctgtgtggggccaccgtcgcgacgtcgccggttatgccgcgggtctggaactgttcgaccgccgtctgccggagctgatggcgctgctgcgcgatgacgacattctgatcctcaccgctgaccacggttgcgatccgacctggaaaggtgaagaccacacgcgtgaacacattccggtactggtatatggcccgaaagtaaaaccgggctcactgggtcatcgtgaaaccttcgcggatatcggccagactctggcaaaatattttggtacctctgatatggaatatggcaaagccatgttc

SEQ ID NO: 546 - protein, 407 aa, Artificial Sequence
  ENGINEERED PHOSPHOPENTOMUTASE VARIANT ENZYMES
MKRAFIMTMDSFGIGATEDAEKFGDVGADTLGHIAEACAKGEADNGRKGPLNVPNLTRLGLAKAHEGSTGFIPAGMDGNAEVIGAYAWAHEMSSGKDSLSGHWEIAGVPVLMEMGYFKDLTNSFPQELLDKLVERANLPGYLGNCRASGTTILDQWGEEHMKTGKPIFYTSEASVFQIAAHEETFGLDKLYELCEIAREELTNGGYNIGRVIARPFIGDKAGNFQRTGNRRDLAQEPGGPTVLQKLVDEKHGQVVGVGKIIDIYAGRGITKKVKATGLDALFDTTIKEMKEAGDNTIVFTCFVDFDSVWGHRRDVAGYAAGLELFDRRLPELMALLRDDDILILTADHGCDPTWKGEDHTREHIPVLVYGPKVKPGSLGHRETFADIGQTLAKYFGTSDMEYGKAMF

SEQ ID NO: 547 - DNA, 771 bp, Artificial Sequence
  Variant of Deoxyribose Phosphate Aldolase From Shewanella Halifaxensis
atgtgcgatctgaagaaggcagcgcagcgggcgattagcctgatggatctgaccaccctgaacgacgatgacaccgaccagaaagtgattgagctgtgccacaaagcgaaaaccccggcgggtgacaccgcggcgatcgtgatttacccgcgtttcatcccgattgcgcgtaagaccctgaacgaaatcggtggcctggacatcaaaattgccaccgttaccaactttccgcacggtaacgatgacattgcgattgcggtgctggagacccgtgcggcggttgcgtacggcgcggatgaagtggacgtggttttcccgtatcgtgcgctgatggaaggtaacgaaaccgtgggctttgagctggttaaggcgtgcaaagaggcgtgcggtgaagatcatattctgaaggtgatcattgaaagtggcgtactgaaagacccggcgctgattcgtaaagcgagcgaaattagcatcgatgcgggtgcggacttcattaagaccagcaccggcaaagttgcggttaacgcgaccctggaggcggcggaaatcattatgaccgttattagcgagaagaacccgaaagtgggtttcaagccggcgggtggcattaaagatgctgcggcggcggcggaatttctgggtgtggcggcgcgtctgctgggcgatgactgggcgaccccggcgaccttccgttttggtgcgaccgacctgctgaccaacctgctgcacaccctggaactggcggacgcgccgcagggtgcgcaaggctat

SEQ ID NO: 548 - protein, 257 aa, Artificial Sequence
  Variant of Deoxyribose Phosphate Aldolase From Shewanella Halifaxensis
MCDLKKAAQRAISLMDLTTLNDDDTDQKVIELCHKAKTPAGDTAAIVIYPRFIPIARKTLNEIGGLDIKIATVTNFPHGNDDIAIAVLETRAAVAYGADEVDVVFPYRALMEGNETVGFELVKACKEACGEDHILKVIIESGVLKDPALIRKASEISIDAGADFIKTSTGKVAVNATLEAAEIIMTVISEKNPKVGFKPAGGIKDAAAAAEFLGVAARLLGDDWATPATFRFGATDLLTNLLHTLELADAPQGAQGY

SEQ ID NO: 549 - DNA, 717 bp, Artificial Sequence
  Variant of Purine Nucleoside Phosphorylase from E. Coli
atgacgaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtgctggtatcccgagctgctccatctacaccaaagaactgatcaccgacttcggcgtgaagaaaattatccgcgtgggtacttgtggcgcagttctgccgcacgtaaaactgcgcgacgtcgttatcggtatgggtgcctgcaccgattccaaagttaaccgcatccgttttaaagaccatgactttgccgctatcgctgacttcgacatggtgcgtaacgcagtagatgcagctaaagcactgggtattgatccgcgcgtgggtaacctgcattccgctgacctgttctactctccggacggcgaaatgttcgacgtgatggaaaaatacggcattgtgggcgtggaaatggaagcggctggtatctacggcgtcgctgcagaatttggcgcgaaagccctgaccatctgcaccgtatctgaccacatccgcactcacgaggctaccactgcggctgagcgtcagactaccttcaacgacatgatcaaaatcgcactggaatccgttctgctgggcgataaagag

SEQ ID NO: 550 - protein, 239 aa, Artificial Sequence
  Variant of Purine Nucleoside Phosphorylase from E. Coli
MTTPHINAEMGDFADVVLMPGDPLRAKYIAETFLEDAREVNNVRGMLGFTGTYKGRKISVMGHGAGIPSCSIYTKELITDFGVKKIIRVGTCGAVLPHVKLRDVVIGMGACTDSKVNRIRFKDHDFAAIADFDMVRNAVDAAKALGIDPRVGNLHSADLFYSPDGEMFDVMEKYGIVGVEMEAAGIYGVAAEFGAKALTICTVSDHIRTHEATTAAERQTTFNDMIKIALESVLLGDKE

SEQ ID NO: 551 - DNA, 1500 bp, Artificial Sequence
  Variant of  Sucrose phosphorylase from Alloscardovia omnicolens
atgaagaacaaagttcaactgattacctatgcggatcgtctgggtgacggcaccctgaagagcatgaccgagaccctgcgtaaacacttcgagggtgtttatgaaggcgtgcacatcctgccgttctttaccccgttcgatggtgcggacgcgggctttgatccggttgaccacaccaaagtggacccgcgtctgggtagctgggacgatgtggcggaactgagcaccacccacgatatcatggttgacaccattgtgaaccacatgagctgggagagcgaacagttccaagatgttatggcgaagggcgaggacagcgaatactatccgatgttcctgaccatgagcagcatttttccggatggtgtgaccgaggaagacctgaccgcgatctatcgtccgcgtccgggtctgccgttcacccactataactggggtggcaaaacccgtctggtttggaccacctttacccgtcagcaagtggacattgataccgacagcgagatgggttggaactacctgctgagcatcctggatcagctgagccaaagccacgttagccaaattcgtctggacgcggtgggttatggcgcgaaggagaaaaacagcagctgcttcctgaccccgaagacctttaaactggtcgaacgtattaaggcggagggtgaaaaacgtggcctggagaccctgatcgaagttcacagctactataagaaacaggtggagattgcgagcaaggtggatcgtgtttacgactttgcgatcccgggtctgctgctgcatgcgctggaatttggcaaaaccgatgcgctggcgcaatggattgacgttcgtccgaacaacgcggtgaacgttctggatacccacgacggtatcggcgttatcgatattggtagcgatcagatggaccgtagcctggcgggtctggtgccggatgaggaagttgacgcgctggttgagagcatccaccgtaacagcaagggtgaaagccaggaagcgaccggcgcggcggcgagcaacctggacctgtaccaagttaactgcacctactatgcggcgctgggtagcgacgatcagaaatatattgcggcgcgtgcggtgcagttctttatgccgggcgtgccgcaagtttactatgtgggtgcgctggcgggcagcaacgatatggacctgctgaagcgtaccaacagtggtcgtggcatcaaccgtcactactatagcgcggcggaagtggcgagcgaggtggaacgtccggtggttcaggcgctgaacgcgctgggccgtttccgtaacaccctgagcgcgttcgatggtgaatttagctacagcaacgcggacggcgttctgaccatgacctgggcggatgatgcgacccgtgcgaccctgacctttgcgccgaaggcgaacagcaacggtgcgagcgtggcgcgtctggagtggaccgatgcggcgggtgaacatgcgaccgacgatctgatcgcgaacccgccggtggttgcg

SEQ ID NO: 552 - protein, 500 aa, Artificial Sequence
  Variant of  Sucrose phosphorylase from Alloscardovia omnicolens
MKNKVQLITYADRLGDGTLKSMTETLRKHFEGVYEGVHILPFFTPFDGADAGFDPVDHTKVDPRLGSWDDVAELSTTHDIMVDTIVNHMSWESEQFQDVMAKGEDSEYYPMFLTMSSIFPDGVTEEDLTAIYRPRPGLPFTHYNWGGKTRLVWTTFTRQQVDIDTDSEMGWNYLLSILDQLSQSHVSQIRLDAVGYGAKEKNSSCFLTPKTFKLVERIKAEGEKRGLETLIEVHSYYKKQVEIASKVDRVYDFAIPGLLLHALEFGKTDALAQWIDVRPNNAVNVLDTHDGIGVIDIGSDQMDRSLAGLVPDEEVDALVESIHRNSKGESQEATGAAASNLDLYQVNCTYYAALGSDDQKYIAARAVQFFMPGVPQVYYVGALAGSNDMDLLKRTNSGRGINRHYYSAAEVASEVERPVVQALNALGRFRNTLSAFDGEFSYSNADGVLTMTWADDATRATLTFAPKANSNGASVARLEWTDAAGEHATDDLIANPPVVA

We claim:

1. An engineered phosphopentomutase comprising a polypeptide sequence having at least 95%, 96%, 97%, 98%, 99%, or more sequence identity to SEQ ID NO: 4, and/or 12 or a functional fragment thereof, wherein the polypeptide sequence of said engineered phosphopentomutase comprises the substitution set 22/188/257/266/341 and wherein the amino acid positions of said polypeptide sequence are numbered with reference to SEQ ID NO: 4.

2. The engineered phosphopentomutase of claim 1, wherein said polypeptide sequence has at least 95%, 96%, 97%, 98%, 99%, or more sequence identity to SEQ ID NO:4, and wherein the polypeptide sequence of said engineered phosphopentomutase comprises the substitution set 22K/188E/257V/266G/341L wherein the amino acid positions of said polypeptide sequence are numbered with reference to SEQ ID NO: 4.

3. The engineered phosphopentomutase of claim 1, wherein said polypeptide sequence of said engineered phosphopentomutase has at least 95%, 96%, 97%, 98%, 99%, or more sequence identity to SEQ ID NO: 12, and wherein said polypeptide sequence of said engineered phosphopentomutase further comprises at least one substitution or substitution set at one or more positions selected from 118, 150, 155, 191, 235, 238, 239, 244, 256, 263, 265, 267, 284, and 355, wherein the amino acid positions of said polypeptide sequence are numbered with reference to SEQ ID NO: 12.

4. The engineered phosphopentomutase of claim 1, wherein said engineered phosphopentomutase comprises a polypeptide sequence that is at least 95%, 96%, 97%, 98%, 99% or more identical to the sequence of at least one engineered phosphopentomutase variant set forth in the even numbered sequences of SEQ ID NOS: 12 and 36-88.

5. The engineered phosphopentomutase of claim 1, wherein said engineered phosphopentomutase comprises a polypeptide sequence forth in at least one of the even numbered sequences of SEQ ID NOS: 12 and 36-88.

6. The engineered phosphopentomutase of claim 1, wherein said engineered phosphopentomutase comprises at least one improved property compared to the phosphopentomutase set forth in SEQ ID NO:4.

7. The engineered phosphopentomutase of claim 6, wherein said improved property comprises improved activity on a substrate.

8. The engineered phosphopentomutase of claim 5, wherein said substrate comprises compound (4).

9. The engineered phosphopentomutase of claim 1, wherein said improved property comprises improved production of compound (1) and/or compound (3).

10. The engineered phosphopentomutase of claim 1, wherein said engineered phosphopentomutase is purified.

11. A composition comprising at least one engineered phosphopentomutase of claim 1.

* * * * *